United States Patent 11,369,692 (MATERIALS AND METHODS FOR TREATMENT OF DUCHENNE MUSCULAR DYSTROPHY) - sequence listing, part 42

SEQ ID NO: 1390914 - DNA, 22 bp, Artificial Sequence
  chemically synthesized
tggaaataaaagacttgaaatt

SEQ ID NO: 1390915 - DNA, 22 bp, Artificial Sequence
  chemically synthesized
ttggaaataaaagacttgaaat

SEQ ID NO: 1390916 - DNA, 22 bp, Artificial Sequence
  chemically synthesized
ttaatttcaagtcttttatttc

SEQ ID NO: 1390917 - DNA, 22 bp, Artificial Sequence
  chemically synthesized
taatttcaagtcttttatttcc

SEQ ID NO: 1390918 - DNA, 22 bp, Artificial Sequence
  chemically synthesized
aatttcaagtcttttatttcca

SEQ ID NO: 1390919 - DNA, 22 bp, Artificial Sequence
  chemically synthesized
atttcaagtcttttatttccaa

SEQ ID NO: 1390920 - DNA, 22 bp, Artificial Sequence
  chemically synthesized
caagtcttttatttccaaaaga

SEQ ID NO: 1390921 - DNA, 22 bp, Artificial Sequence
  chemically synthesized
aagtcttttatttccaaaagat

SEQ ID NO: 1390922 - DNA, 22 bp, Artificial Sequence
  chemically synthesized
ttatttccaaaagattttctgt

SEQ ID NO: 1390923 - DNA, 22 bp, Artificial Sequence
  chemically synthesized
tatttccaaaagattttctgtg

SEQ ID NO: 1390924 - DNA, 22 bp, Artificial Sequence
  chemically synthesized
taatagataatccacagaaaat

SEQ ID NO: 1390925 - DNA, 22 bp, Artificial Sequence
  chemically synthesized
atttccaaaagattttctgtgg

SEQ ID NO: 1390926 - DNA, 22 bp, Artificial Sequence
  chemically synthesized
tttccaaaagattttctgtgga

SEQ ID NO: 1390927 - DNA, 22 bp, Artificial Sequence
  chemically synthesized
ccaaaagattttctgtggatta

SEQ ID NO: 1390928 - DNA, 22 bp, Artificial Sequence
  chemically synthesized
caaaagattttctgtggattat

SEQ ID NO: 1390929 - DNA, 22 bp, Artificial Sequence
  chemically synthesized
gtaactataatagataatccac

SEQ ID NO: 1390930 - DNA, 22 bp, Artificial Sequence
  chemically synthesized
ttagtaactataatagataatc

SEQ ID NO: 1390931 - DNA, 22 bp, Artificial Sequence
  chemically synthesized
gttagtaactataatagataat

SEQ ID NO: 1390932 - DNA, 22 bp, Artificial Sequence
  chemically synthesized
tgttagtaactataatagataa

SEQ ID NO: 1390933 - DNA, 22 bp, Artificial Sequence
  chemically synthesized
ttttgttagtaactataataga

SEQ ID NO: 1390934 - DNA, 22 bp, Artificial Sequence
  chemically synthesized
tctgtggattatctattatagt

SEQ ID NO: 1390935 - DNA, 22 bp, Artificial Sequence
  chemically synthesized
ctgtggattatctattatagtt

SEQ ID NO: 1390936 - DNA, 22 bp, Artificial Sequence
  chemically synthesized
tgtggattatctattatagtta

SEQ ID NO: 1390937 - DNA, 22 bp, Artificial Sequence
  chemically synthesized
ttattttgttagtaactataat

SEQ ID NO: 1390938 - DNA, 22 bp, Artificial Sequence
  chemically synthesized
tggattatctattatagttact

SEQ ID NO: 1390939 - DNA, 22 bp, Artificial Sequence
  chemically synthesized
tctattatagttactaacaaaa

SEQ ID NO: 1390940 - DNA, 22 bp, Artificial Sequence
  chemically synthesized
gtgtgaattattattttgttag

SEQ ID NO: 1390941 - DNA, 22 bp, Artificial Sequence
  chemically synthesized
ttatagttactaacaaaataat

SEQ ID NO: 1390942 - DNA, 22 bp, Artificial Sequence
  chemically synthesized
cctggtgtgaattattattttg

SEQ ID NO: 1390943 - DNA, 22 bp, Artificial Sequence
  chemically synthesized
tagttactaacaaaataataat

SEQ ID NO: 1390944 - DNA, 22 bp, Artificial Sequence
  chemically synthesized
ctaacaaaataataattcacac

SEQ ID NO: 1390945 - DNA, 22 bp, Artificial Sequence
  chemically synthesized
acaaaataataattcacaccag

SEQ ID NO: 1390946 - DNA, 22 bp, Artificial Sequence
  chemically synthesized
tcaaataccaggatataattgc

SEQ ID NO: 1390947 - DNA, 22 bp, Artificial Sequence
  chemically synthesized
atcaaataccaggatataattg

SEQ ID NO: 1390948 - DNA, 22 bp, Artificial Sequence
  chemically synthesized
tatcaaataccaggatataatt

SEQ ID NO: 1390949 - DNA, 22 bp, Artificial Sequence
  chemically synthesized
acaccaggcaattatatcctgg

SEQ ID NO: 1390950 - DNA, 22 bp, Artificial Sequence
  chemically synthesized
tatcctggtatttgataaaact

SEQ ID NO: 1390951 - DNA, 22 bp, Artificial Sequence
  chemically synthesized
aaatggtaaacatccaagtttt

SEQ ID NO: 1390952 - DNA, 22 bp, Artificial Sequence
  chemically synthesized
gaaatggtaaacatccaagttt

SEQ ID NO: 1390953 - DNA, 22 bp, Artificial Sequence
  chemically synthesized
gtatttgataaaacttggatgt

SEQ ID NO: 1390954 - DNA, 22 bp, Artificial Sequence
  chemically synthesized
ttgaaatggtaaacatccaagt

SEQ ID NO: 1390955 - DNA, 22 bp, Artificial Sequence
  chemically synthesized
gataaaacttggatgtttacca

SEQ ID NO: 1390956 - DNA, 22 bp, Artificial Sequence
  chemically synthesized
ataaaacttggatgtttaccat

SEQ ID NO: 1390957 - DNA, 22 bp, Artificial Sequence
  chemically synthesized
aggaaatcattcttgaaatggt

SEQ ID NO: 1390958 - DNA, 22 bp, Artificial Sequence
  chemically synthesized
caggaaatcattcttgaaatgg

SEQ ID NO: 1390959 - DNA, 22 bp, Artificial Sequence
  chemically synthesized
tcaggaaatcattcttgaaatg

SEQ ID NO: 1390960 - DNA, 22 bp, Artificial Sequence
  chemically synthesized
ttcaggaaatcattcttgaaat

SEQ ID NO: 1390961 - DNA, 22 bp, Artificial Sequence
  chemically synthesized
ggatgtttaccatttcaagaat

SEQ ID NO: 1390962 - DNA, 22 bp, Artificial Sequence
  chemically synthesized
tttcaggaaatcattcttgaaa

SEQ ID NO: 1390963 - DNA, 22 bp, Artificial Sequence
  chemically synthesized
gatgtttaccatttcaagaatg

SEQ ID NO: 1390964 - DNA, 22 bp, Artificial Sequence
  chemically synthesized
tttttcaggaaatcattcttga

SEQ ID NO: 1390965 - DNA, 22 bp, Artificial Sequence
  chemically synthesized
ctttttcaggaaatcattcttg

SEQ ID NO: 1390966 - DNA, 22 bp, Artificial Sequence
  chemically synthesized
tctttttcaggaaatcattctt

SEQ ID NO: 1390967 - DNA, 22 bp, Artificial Sequence
  chemically synthesized
ttctttttcaggaaatcattct

SEQ ID NO: 1390968 - DNA, 22 bp, Artificial Sequence
  chemically synthesized
tttctttttcaggaaatcattc

SEQ ID NO: 1390969 - DNA, 22 bp, Artificial Sequence
  chemically synthesized
accatttcaagaatgatttcct

SEQ ID NO: 1390970 - DNA, 22 bp, Artificial Sequence
  chemically synthesized
tttttctttttcaggaaatcat

SEQ ID NO: 1390971 - DNA, 22 bp, Artificial Sequence
  chemically synthesized
ccatttcaagaatgatttcctg

SEQ ID NO: 1390972 - DNA, 22 bp, Artificial Sequence
  chemically synthesized
ctttttctttttcaggaaatca

SEQ ID NO: 1390973 - DNA, 22 bp, Artificial Sequence
  chemically synthesized
tctttttctttttcaggaaatc

SEQ ID NO: 1390974 - DNA, 22 bp, Artificial Sequence
  chemically synthesized
ttttctttttctttttcaggaa

SEQ ID NO: 1390975 - DNA, 22 bp, Artificial Sequence
  chemically synthesized
caagaatgatttcctgaaaaag

SEQ ID NO: 1390976 - DNA, 22 bp, Artificial Sequence
  chemically synthesized
aagaatgatttcctgaaaaaga

SEQ ID NO: 1390977 - DNA, 22 bp, Artificial Sequence
  chemically synthesized
aatatcagctgttttctttttc

SEQ ID NO: 1390978 - DNA, 22 bp, Artificial Sequence
  chemically synthesized
gaatatcagctgttttcttttt

SEQ ID NO: 1390979 - DNA, 22 bp, Artificial Sequence
  chemically synthesized
tgaatatcagctgttttctttt

SEQ ID NO: 1390980 - DNA, 22 bp, Artificial Sequence
  chemically synthesized
cctgaaaaagaaaaagaaaaca

SEQ ID NO: 1390981 - DNA, 22 bp, Artificial Sequence
  chemically synthesized
ctgaaaaagaaaaagaaaacag

SEQ ID NO: 1390982 - DNA, 22 bp, Artificial Sequence
  chemically synthesized
actttgaatatcagctgttttc

SEQ ID NO: 1390983 - DNA, 22 bp, Artificial Sequence
  chemically synthesized
aaaaagaaaaagaaaacagctg

SEQ ID NO: 1390984 - DNA, 22 bp, Artificial Sequence
  chemically synthesized
cagaaaatggctgactttgaat

SEQ ID NO: 1390985 - DNA, 22 bp, Artificial Sequence
  chemically synthesized
tgcagaaaatggctgactttga

SEQ ID NO: 1390986 - DNA, 22 bp, Artificial Sequence
  chemically synthesized
attctgcagaaaatggctgact

SEQ ID NO: 1390987 - DNA, 22 bp, Artificial Sequence
  chemically synthesized
ctcattctgcagaaaatggctg

SEQ ID NO: 1390988 - DNA, 22 bp, Artificial Sequence
  chemically synthesized
atattcaaagtcagccattttc

SEQ ID NO: 1390989 - DNA, 22 bp, Artificial Sequence
  chemically synthesized
aaagtcagccattttctgcaga

SEQ ID NO: 1390990 - DNA, 22 bp, Artificial Sequence
  chemically synthesized
aataattgctcattctgcagaa

SEQ ID NO: 1390991 - DNA, 22 bp, Artificial Sequence
  chemically synthesized
aaataattgctcattctgcaga

SEQ ID NO: 1390992 - DNA, 22 bp, Artificial Sequence
  chemically synthesized
taaataattgctcattctgcag

SEQ ID NO: 1390993 - DNA, 22 bp, Artificial Sequence
  chemically synthesized
ttaaataattgctcattctgca

SEQ ID NO: 1390994 - DNA, 22 bp, Artificial Sequence
  chemically synthesized
cttttaaataattgctcattct

SEQ ID NO: 1390995 - DNA, 22 bp, Artificial Sequence
  chemically synthesized
ccttttaaataattgctcattc

SEQ ID NO: 1390996 - DNA, 22 bp, Artificial Sequence
  chemically synthesized
tttccttttaaataattgctca

SEQ ID NO: 1390997 - DNA, 22 bp, Artificial Sequence
  chemically synthesized
tctgcagaatgagcaattattt

SEQ ID NO: 1390998 - DNA, 22 bp, Artificial Sequence
  chemically synthesized
ctgcagaatgagcaattattta

SEQ ID NO: 1390999 - DNA, 22 bp, Artificial Sequence
  chemically synthesized
tgcagaatgagcaattatttaa

SEQ ID NO: 1391000 - DNA, 22 bp, Artificial Sequence
  chemically synthesized
cagaatgagcaattatttaaaa

SEQ ID NO: 1391001 - DNA, 22 bp, Artificial Sequence
  chemically synthesized
aaagttatttccttttaaataa

SEQ ID NO: 1391002 - DNA, 22 bp, Artificial Sequence
  chemically synthesized
aaaagttatttccttttaaata

SEQ ID NO: 1391003 - DNA, 22 bp, Artificial Sequence
  chemically synthesized
atttaaaagttatttcctttta

SEQ ID NO: 1391004 - DNA, 22 bp, Artificial Sequence
  chemically synthesized
tttaaaaggaaataacttttaa

SEQ ID NO: 1391005 - DNA, 22 bp, Artificial Sequence
  chemically synthesized
aaaaggaaataacttttaaatg

SEQ ID NO: 1391006 - DNA, 22 bp, Artificial Sequence
  chemically synthesized
aaaggaaataacttttaaatga

SEQ ID NO: 1391007 - DNA, 22 bp, Artificial Sequence
  chemically synthesized
gaatatatgcgctcatttaaaa

SEQ ID NO: 1391008 - DNA, 22 bp, Artificial Sequence
  chemically synthesized
ttaaatgagcgcatatattcca

SEQ ID NO: 1391009 - DNA, 22 bp, Artificial Sequence
  chemically synthesized
taaatgagcgcatatattccag

SEQ ID NO: 1391010 - DNA, 22 bp, Artificial Sequence
  chemically synthesized
aaatgagcgcatatattccagg

SEQ ID NO: 1391011 - DNA, 22 bp, Artificial Sequence
  chemically synthesized
aatgagcgcatatattccaggc

SEQ ID NO: 1391012 - DNA, 22 bp, Artificial Sequence
  chemically synthesized
agtaagcagcagaaaatatgtg

SEQ ID NO: 1391013 - DNA, 22 bp, Artificial Sequence
  chemically synthesized
ttcagtaagcagcagaaaatat

SEQ ID NO: 1391014 - DNA, 22 bp, Artificial Sequence
  chemically synthesized
gttcagtaagcagcagaaaata

SEQ ID NO: 1391015 - DNA, 22 bp, Artificial Sequence
  chemically synthesized
caggcacatattttctgctgct

SEQ ID NO: 1391016 - DNA, 22 bp, Artificial Sequence
  chemically synthesized
aagtggacttgttcagtaagca

SEQ ID NO: 1391017 - DNA, 22 bp, Artificial Sequence
  chemically synthesized
gaagtggacttgttcagtaagc

SEQ ID NO: 1391018 - DNA, 22 bp, Artificial Sequence
  chemically synthesized
tgtttgaagtggacttgttcag

SEQ ID NO: 1391019 - DNA, 22 bp, Artificial Sequence
  chemically synthesized
tctgctgcttactgaacaagtc

SEQ ID NO: 1391020 - DNA, 22 bp, Artificial Sequence
  chemically synthesized
ctgctgcttactgaacaagtcc

SEQ ID NO: 1391021 - DNA, 22 bp, Artificial Sequence
  chemically synthesized
tgctgcttactgaacaagtcca

SEQ ID NO: 1391022 - DNA, 22 bp, Artificial Sequence
  chemically synthesized
ctgcttactgaacaagtccact

SEQ ID NO: 1391023 - DNA, 22 bp, Artificial Sequence
  chemically synthesized
cttactgaacaagtccacttca

SEQ ID NO: 1391024 - DNA, 22 bp, Artificial Sequence
  chemically synthesized
actgaacaagtccacttcaaac

SEQ ID NO: 1391025 - DNA, 22 bp, Artificial Sequence
  chemically synthesized
atgtcatgttatgtttgaagtg

SEQ ID NO: 1391026 - DNA, 22 bp, Artificial Sequence
  chemically synthesized
ctgaacaagtccacttcaaaca

SEQ ID NO: 1391027 - DNA, 22 bp, Artificial Sequence
  chemically synthesized
ttcatgtcatgttatgtttgaa

SEQ ID NO: 1391028 - DNA, 22 bp, Artificial Sequence
  chemically synthesized
aacaagtccacttcaaacataa

SEQ ID NO: 1391029 - DNA, 22 bp, Artificial Sequence
  chemically synthesized
attcatgtcatgttatgtttga

SEQ ID NO: 1391030 - DNA, 22 bp, Artificial Sequence
  chemically synthesized
tattcatgtcatgttatgtttg

SEQ ID NO: 1391031 - DNA, 22 bp, Artificial Sequence
  chemically synthesized
ttattcatgtcatgttatgttt

SEQ ID NO: 1391032 - DNA, 22 bp, Artificial Sequence
  chemically synthesized
tttattcatgtcatgttatgtt

SEQ ID NO: 1391033 - DNA, 22 bp, Artificial Sequence
  chemically synthesized
ttttttattcatgtcatgttat

SEQ ID NO: 1391034 - DNA, 22 bp, Artificial Sequence
  chemically synthesized
gttttttattcatgtcatgtta

SEQ ID NO: 1391035 - DNA, 22 bp, Artificial Sequence
  chemically synthesized
tgttttttattcatgtcatgtt

SEQ ID NO: 1391036 - DNA, 22 bp, Artificial Sequence
  chemically synthesized
ttgttttttattcatgtcatgt

SEQ ID NO: 1391037 - DNA, 22 bp, Artificial Sequence
  chemically synthesized
ttttgttttttattcatgtcat

SEQ ID NO: 1391038 - DNA, 22 bp, Artificial Sequence
  chemically synthesized
cttttgttttttattcatgtca

SEQ ID NO: 1391039 - DNA, 22 bp, Artificial Sequence
  chemically synthesized
caaacataacatgacatgaata

SEQ ID NO: 1391040 - DNA, 22 bp, Artificial Sequence
  chemically synthesized
tcttttgttttttattcatgtc

SEQ ID NO: 1391041 - DNA, 22 bp, Artificial Sequence
  chemically synthesized
aaacataacatgacatgaataa

SEQ ID NO: 1391042 - DNA, 22 bp, Artificial Sequence
  chemically synthesized
ttttcttttgttttttattcat

SEQ ID NO: 1391043 - DNA, 22 bp, Artificial Sequence
  chemically synthesized
gttttcttttgttttttattca

SEQ ID NO: 1391044 - DNA, 22 bp, Artificial Sequence
  chemically synthesized
tgttttcttttgttttttattc

SEQ ID NO: 1391045 - DNA, 22 bp, Artificial Sequence
  chemically synthesized
gttttgttttcttttgtttttt

SEQ ID NO: 1391046 - DNA, 22 bp, Artificial Sequence
  chemically synthesized
gggtggaattcgttttgttttc

SEQ ID NO: 1391047 - DNA, 22 bp, Artificial Sequence
  chemically synthesized
ggggtggaattcgttttgtttt

SEQ ID NO: 1391048 - DNA, 22 bp, Artificial Sequence
  chemically synthesized
caccccaaatgtgctcctcctt

SEQ ID NO: 1391049 - DNA, 22 bp, Artificial Sequence
  chemically synthesized
ccaaggtgagaaatatataagg

SEQ ID NO: 1391050 - DNA, 22 bp, Artificial Sequence
  chemically synthesized
accaaggtgagaaatatataag

SEQ ID NO: 1391051 - DNA, 22 bp, Artificial Sequence
  chemically synthesized
catttaccaaggtgagaaatat

SEQ ID NO: 1391052 - DNA, 22 bp, Artificial Sequence
  chemically synthesized
ctccttatatatttctcacctt

SEQ ID NO: 1391053 - DNA, 22 bp, Artificial Sequence
  chemically synthesized
cttatatatttctcaccttggt

SEQ ID NO: 1391054 - DNA, 22 bp, Artificial Sequence
  chemically synthesized
atatatttctcaccttggtaaa

SEQ ID NO: 1391055 - DNA, 22 bp, Artificial Sequence
  chemically synthesized
tatatttctcaccttggtaaat

SEQ ID NO: 1391056 - DNA, 22 bp, Artificial Sequence
  chemically synthesized
ataaatagtagttccatttacc

SEQ ID NO: 1391057 - DNA, 22 bp, Artificial Sequence
  chemically synthesized
aataaatagtagttccatttac

SEQ ID NO: 1391058 - DNA, 22 bp, Artificial Sequence
  chemically synthesized
ctcaccttggtaaatggaacta

SEQ ID NO: 1391059 - DNA, 22 bp, Artificial Sequence
  chemically synthesized
tcaccttggtaaatggaactac

SEQ ID NO: 1391060 - DNA, 22 bp, Artificial Sequence
  chemically synthesized
accttggtaaatggaactacta

SEQ ID NO: 1391061 - DNA, 22 bp, Artificial Sequence
  chemically synthesized
ggtaaatggaactactatttat

SEQ ID NO: 1391062 - DNA, 22 bp, Artificial Sequence
  chemically synthesized
gtaaatggaactactatttatt

SEQ ID NO: 1391063 - DNA, 22 bp, Artificial Sequence
  chemically synthesized
acaagagaagtttaataaatag

SEQ ID NO: 1391064 - DNA, 22 bp, Artificial Sequence
  chemically synthesized
tgacaagagaagtttaataaat

SEQ ID NO: 1391065 - DNA, 22 bp, Artificial Sequence
  chemically synthesized
ctatttattaaacttctcttgt

SEQ ID NO: 1391066 - DNA, 22 bp, Artificial Sequence
  chemically synthesized
tttattaaacttctcttgtcag

SEQ ID NO: 1391067 - DNA, 22 bp, Artificial Sequence
  chemically synthesized
aatgatacaaagttctgacaag

SEQ ID NO: 1391068 - DNA, 22 bp, Artificial Sequence
  chemically synthesized
attaaacttctcttgtcagaac

SEQ ID NO: 1391069 - DNA, 22 bp, Artificial Sequence
  chemically synthesized
aaatgatacaaagttctgacaa

SEQ ID NO: 1391070 - DNA, 22 bp, Artificial Sequence
  chemically synthesized
ttaaacttctcttgtcagaact

SEQ ID NO: 1391071 - DNA, 22 bp, Artificial Sequence
  chemically synthesized
aacttctcttgtcagaactttg

SEQ ID NO: 1391072 - DNA, 22 bp, Artificial Sequence
  chemically synthesized
ctcttgtcagaactttgtatca

SEQ ID NO: 1391073 - DNA, 22 bp, Artificial Sequence
  chemically synthesized
tcttgtcagaactttgtatcat

SEQ ID NO: 1391074 - DNA, 22 bp, Artificial Sequence
  chemically synthesized
ttgtcagaactttgtatcattt

SEQ ID NO: 1391075 - DNA, 22 bp, Artificial Sequence
  chemically synthesized
gtcagaactttgtatcatttaa

SEQ ID NO: 1391076 - DNA, 22 bp, Artificial Sequence
  chemically synthesized
tcagaactttgtatcatttaag

SEQ ID NO: 1391077 - DNA, 22 bp, Artificial Sequence
  chemically synthesized
tgtatcatttaagatttctgtc

SEQ ID NO: 1391078 - DNA, 22 bp, Artificial Sequence
  chemically synthesized
gtatcatttaagatttctgtct

SEQ ID NO: 1391079 - DNA, 22 bp, Artificial Sequence
  chemically synthesized
tatcatttaagatttctgtctt

SEQ ID NO: 1391080 - DNA, 22 bp, Artificial Sequence
  chemically synthesized
aatgaaggtgaggaagacagaa

SEQ ID NO: 1391081 - DNA, 22 bp, Artificial Sequence
  chemically synthesized
attaaatgaaggtgaggaagac

SEQ ID NO: 1391082 - DNA, 22 bp, Artificial Sequence
  chemically synthesized
gattaaatgaaggtgaggaaga

SEQ ID NO: 1391083 - DNA, 22 bp, Artificial Sequence
  chemically synthesized
aagatttctgtcttcctcacct

SEQ ID NO: 1391084 - DNA, 22 bp, Artificial Sequence
  chemically synthesized
agatttctgtcttcctcacctt

SEQ ID NO: 1391085 - DNA, 22 bp, Artificial Sequence
  chemically synthesized
aagcttgattaaatgaaggtga

SEQ ID NO: 1391086 - DNA, 22 bp, Artificial Sequence
  chemically synthesized
gaagcttgattaaatgaaggtg

SEQ ID NO: 1391087 - DNA, 22 bp, Artificial Sequence
  chemically synthesized
ctgtcttcctcaccttcattta

SEQ ID NO: 1391088 - DNA, 22 bp, Artificial Sequence
  chemically synthesized
tgtcttcctcaccttcatttaa

SEQ ID NO: 1391089 - DNA, 22 bp, Artificial Sequence
  chemically synthesized
tcttcctcaccttcatttaatc

SEQ ID NO: 1391090 - DNA, 22 bp, Artificial Sequence
  chemically synthesized
cgtgtcttgaagcttgattaaa

SEQ ID NO: 1391091 - DNA, 22 bp, Artificial Sequence
  chemically synthesized
cctcaccttcatttaatcaagc

SEQ ID NO: 1391092 - DNA, 22 bp, Artificial Sequence
  chemically synthesized
ctcaccttcatttaatcaagct

SEQ ID NO: 1391093 - DNA, 22 bp, Artificial Sequence
  chemically synthesized
accttcatttaatcaagcttca

SEQ ID NO: 1391094 - DNA, 22 bp, Artificial Sequence
  chemically synthesized
catttaatcaagcttcaagaca

SEQ ID NO: 1391095 - DNA, 22 bp, Artificial Sequence
  chemically synthesized
atttaatcaagcttcaagacac

SEQ ID NO: 1391096 - DNA, 22 bp, Artificial Sequence
  chemically synthesized
gtggtagaatctacgtgtcttg

SEQ ID NO: 1391097 - DNA, 22 bp, Artificial Sequence
  chemically synthesized
agtggtagaatctacgtgtctt

SEQ ID NO: 1391098 - DNA, 22 bp, Artificial Sequence
  chemically synthesized
aatcaagcttcaagacacgtag

SEQ ID NO: 1391099 - DNA, 22 bp, Artificial Sequence
  chemically synthesized
tagtggtagaatctacgtgtct

SEQ ID NO: 1391100 - DNA, 22 bp, Artificial Sequence
  chemically synthesized
atcaagcttcaagacacgtaga

SEQ ID NO: 1391101 - DNA, 22 bp, Artificial Sequence
  chemically synthesized
ttagtggtagaatctacgtgtc

SEQ ID NO: 1391102 - DNA, 22 bp, Artificial Sequence
  chemically synthesized
tttagtggtagaatctacgtgt

SEQ ID NO: 1391103 - DNA, 22 bp, Artificial Sequence
  chemically synthesized
caagacacgtagattctaccac

SEQ ID NO: 1391104 - DNA, 22 bp, Artificial Sequence
  chemically synthesized
aagacacgtagattctaccact

SEQ ID NO: 1391105 - DNA, 22 bp, Artificial Sequence
  chemically synthesized
aaaacactttttagtggtagaa

SEQ ID NO: 1391106 - DNA, 22 bp, Artificial Sequence
  chemically synthesized
aaaaacactttttagtggtaga

SEQ ID NO: 1391107 - DNA, 22 bp, Artificial Sequence
  chemically synthesized
tttaaaaacactttttagtggt

SEQ ID NO: 1391108 - DNA, 22 bp, Artificial Sequence
  chemically synthesized
taccactaaaaagtgtttttaa

SEQ ID NO: 1391109 - DNA, 22 bp, Artificial Sequence
  chemically synthesized
ccactaaaaagtgtttttaaac

SEQ ID NO: 1391110 - DNA, 22 bp, Artificial Sequence
  chemically synthesized
aaaagtgtttttaaacagtgtc

SEQ ID NO: 1391111 - DNA, 22 bp, Artificial Sequence
  chemically synthesized
gaatagtaacaatagacactgt

SEQ ID NO: 1391112 - DNA, 22 bp, Artificial Sequence
  chemically synthesized
attagaatagtaacaatagaca

SEQ ID NO: 1391113 - DNA, 22 bp, Artificial Sequence
  chemically synthesized
gattagaatagtaacaatagac

SEQ ID NO: 1391114 - DNA, 22 bp, Artificial Sequence
  chemically synthesized
tgattagaatagtaacaataga

SEQ ID NO: 1391115 - DNA, 22 bp, Artificial Sequence
  chemically synthesized
ttaaacagtgtctattgttact

SEQ ID NO: 1391116 - DNA, 22 bp, Artificial Sequence
  chemically synthesized
taaacagtgtctattgttacta

SEQ ID NO: 1391117 - DNA, 22 bp, Artificial Sequence
  chemically synthesized
aaacagtgtctattgttactat

SEQ ID NO: 1391118 - DNA, 22 bp, Artificial Sequence
  chemically synthesized
aacagtgtctattgttactatt

SEQ ID NO: 1391119 - DNA, 22 bp, Artificial Sequence
  chemically synthesized
ttgttactattctaatcaaaat

SEQ ID NO: 1391120 - DNA, 22 bp, Artificial Sequence
  chemically synthesized
ttactattctaatcaaaatcat

SEQ ID NO: 1391121 - DNA, 22 bp, Artificial Sequence
  chemically synthesized
ctattctaatcaaaatcatatt

SEQ ID NO: 1391122 - DNA, 22 bp, Artificial Sequence
  chemically synthesized
ttctaatcaaaatcatattaca

SEQ ID NO: 1391123 - DNA, 22 bp, Artificial Sequence
  chemically synthesized
taaagtcataagtgtaatatga

SEQ ID NO: 1391124 - DNA, 22 bp, Artificial Sequence
  chemically synthesized
ataaagtcataagtgtaatatg

SEQ ID NO: 1391125 - DNA, 22 bp, Artificial Sequence
  chemically synthesized
taatcaaaatcatattacactt

SEQ ID NO: 1391126 - DNA, 22 bp, Artificial Sequence
  chemically synthesized
atcaaaatcatattacacttat

SEQ ID NO: 1391127 - DNA, 22 bp, Artificial Sequence
  chemically synthesized
cacttatgactttataagtact

SEQ ID NO: 1391128 - DNA, 22 bp, Artificial Sequence
  chemically synthesized
atgactttataagtactacgac

SEQ ID NO: 1391129 - DNA, 22 bp, Artificial Sequence
  chemically synthesized
tgactttataagtactacgacc

SEQ ID NO: 1391130 - DNA, 22 bp, Artificial Sequence
  chemically synthesized
tataagtactacgacctcctac

SEQ ID NO: 1391131 - DNA, 22 bp, Artificial Sequence
  chemically synthesized
ataagtactacgacctcctact

SEQ ID NO: 1391132 - DNA, 22 bp, Artificial Sequence
  chemically synthesized
taagtactacgacctcctactg

SEQ ID NO: 1391133 - DNA, 22 bp, Artificial Sequence
  chemically synthesized
aggaaagatgaaagaccagtag

SEQ ID NO: 1391134 - DNA, 22 bp, Artificial Sequence
  chemically synthesized
cgacctcctactggtctttcat

SEQ ID NO: 1391135 - DNA, 22 bp, Artificial Sequence
  chemically synthesized
ctactggtctttcatctttcct

SEQ ID NO: 1391136 - DNA, 22 bp, Artificial Sequence
  chemically synthesized
ctggtctttcatctttcctcag

SEQ ID NO: 1391137 - DNA, 22 bp, Artificial Sequence
  chemically synthesized
gaggatcaacaggctgaggaaa

SEQ ID NO: 1391138 - DNA, 22 bp, Artificial Sequence
  chemically synthesized
gtctttcatctttcctcagcct

SEQ ID NO: 1391139 - DNA, 22 bp, Artificial Sequence
  chemically synthesized
tcatctttcctcagcctgttga

SEQ ID NO: 1391140 - DNA, 22 bp, Artificial Sequence
  chemically synthesized
catctttcctcagcctgttgat

SEQ ID NO: 1391141 - DNA, 22 bp, Artificial Sequence
  chemically synthesized
atctttcctcagcctgttgatc

SEQ ID NO: 1391142 - DNA, 22 bp, Artificial Sequence
  chemically synthesized
tatagggattggaggatcaaca

SEQ ID NO: 1391143 - DNA, 22 bp, Artificial Sequence
  chemically synthesized
atatagggattggaggatcaac

SEQ ID NO: 1391144 - DNA, 22 bp, Artificial Sequence
  chemically synthesized
tcctcagcctgttgatcctcca

SEQ ID NO: 1391145 - DNA, 22 bp, Artificial Sequence
  chemically synthesized
cctcagcctgttgatcctccaa

SEQ ID NO: 1391146 - DNA, 22 bp, Artificial Sequence
  chemically synthesized
ctcagcctgttgatcctccaat

SEQ ID NO: 1391147 - DNA, 22 bp, Artificial Sequence
  chemically synthesized
agcctgttgatcctccaatccc

SEQ ID NO: 1391148 - DNA, 22 bp, Artificial Sequence
  chemically synthesized
ttgatcctccaatccctatata

SEQ ID NO: 1391149 - DNA, 22 bp, Artificial Sequence
  chemically synthesized
ggaatagaggtacttatatagg

SEQ ID NO: 1391150 - DNA, 22 bp, Artificial Sequence
  chemically synthesized
atcctccaatccctatataagt

SEQ ID NO: 1391151 - DNA, 22 bp, Artificial Sequence
  chemically synthesized
ttgggaatagaggtacttatat

SEQ ID NO: 1391152 - DNA, 22 bp, Artificial Sequence
  chemically synthesized
attgggaatagaggtacttata

SEQ ID NO: 1391153 - DNA, 22 bp, Artificial Sequence
  chemically synthesized
tattgggaatagaggtacttat

SEQ ID NO: 1391154 - DNA, 22 bp, Artificial Sequence
  chemically synthesized
caatccctatataagtacctct

SEQ ID NO: 1391155 - DNA, 22 bp, Artificial Sequence
  chemically synthesized
tataagtacctctattcccaat

SEQ ID NO: 1391156 - DNA, 22 bp, Artificial Sequence
  chemically synthesized
atgtggcagagagactttattg

SEQ ID NO: 1391157 - DNA, 22 bp, Artificial Sequence
  chemically synthesized
tattcccaataaagtctctctg

SEQ ID NO: 1391158 - DNA, 22 bp, Artificial Sequence
  chemically synthesized
tgagttcatgtggcagagagac

SEQ ID NO: 1391159 - DNA, 22 bp, Artificial Sequence
  chemically synthesized
ttcccaataaagtctctctgcc

SEQ ID NO: 1391160 - DNA, 22 bp, Artificial Sequence
  chemically synthesized
ccaataaagtctctctgccaca

SEQ ID NO: 1391161 - DNA, 22 bp, Artificial Sequence
  chemically synthesized
attgtgagttcatgtggcagag

SEQ ID NO: 1391162 - DNA, 22 bp, Artificial Sequence
  chemically synthesized
aagctcattgtgagttcatgtg

SEQ ID NO: 1391163 - DNA, 22 bp, Artificial Sequence
  chemically synthesized
aaagctcattgtgagttcatgt

SEQ ID NO: 1391164 - DNA, 22 bp, Artificial Sequence
  chemically synthesized
taaagctcattgtgagttcatg

SEQ ID NO: 1391165 - DNA, 22 bp, Artificial Sequence
  chemically synthesized
ttaaagctcattgtgagttcat

SEQ ID NO: 1391166 - DNA, 22 bp, Artificial Sequence
  chemically synthesized
tttaaagctcattgtgagttca

SEQ ID NO: 1391167 - DNA, 22 bp, Artificial Sequence
  chemically synthesized
tctgccacatgaactcacaatg

SEQ ID NO: 1391168 - DNA, 22 bp, Artificial Sequence
  chemically synthesized
tctttttaaagctcattgtgag

SEQ ID NO: 1391169 - DNA, 22 bp, Artificial Sequence
  chemically synthesized
tgccacatgaactcacaatgag

SEQ ID NO: 1391170 - DNA, 22 bp, Artificial Sequence
  chemically synthesized
atctttttaaagctcattgtga

SEQ ID NO: 1391171 - DNA, 22 bp, Artificial Sequence
  chemically synthesized
tatctttttaaagctcattgtg

SEQ ID NO: 1391172 - DNA, 22 bp, Artificial Sequence
  chemically synthesized
ccacatgaactcacaatgagct

SEQ ID NO: 1391173 - DNA, 22 bp, Artificial Sequence
  chemically synthesized
acaatgagctttaaaaagataa

SEQ ID NO: 1391174 - DNA, 22 bp, Artificial Sequence
  chemically synthesized
taaaaagataaagatgatgatg

SEQ ID NO: 1391175 - DNA, 22 bp, Artificial Sequence
  chemically synthesized
aaaaagataaagatgatgatgt

SEQ ID NO: 1391176 - DNA, 22 bp, Artificial Sequence
  chemically synthesized
aaaagataaagatgatgatgtt

SEQ ID NO: 1391177 - DNA, 22 bp, Artificial Sequence
  chemically synthesized
gtcaaacggaataacatcatca

SEQ ID NO: 1391178 - DNA, 22 bp, Artificial Sequence
  chemically synthesized
agtcaaacggaataacatcatc

SEQ ID NO: 1391179 - DNA, 22 bp, Artificial Sequence
  chemically synthesized
tgagatttagtcaaacggaata

SEQ ID NO: 1391180 - DNA, 22 bp, Artificial Sequence
  chemically synthesized
atgagatttagtcaaacggaat

SEQ ID NO: 1391181 - DNA, 22 bp, Artificial Sequence
  chemically synthesized
ttccgtttgactaaatctcata

SEQ ID NO: 1391182 - DNA, 22 bp, Artificial Sequence
  chemically synthesized
cgtttgactaaatctcataagc

SEQ ID NO: 1391183 - DNA, 22 bp, Artificial Sequence
  chemically synthesized
gactaaatctcataagcggctc

SEQ ID NO: 1391184 - DNA, 22 bp, Artificial Sequence
  chemically synthesized
actaaatctcataagcggctcc

SEQ ID NO: 1391185 - DNA, 22 bp, Artificial Sequence
  chemically synthesized
taaccaaaaaaataaggagccg

SEQ ID NO: 1391186 - DNA, 22 bp, Artificial Sequence
  chemically synthesized
aatctcataagcggctccttat

SEQ ID NO: 1391187 - DNA, 22 bp, Artificial Sequence
  chemically synthesized
ataaccaaaaaaataaggagcc

SEQ ID NO: 1391188 - DNA, 22 bp, Artificial Sequence
  chemically synthesized
tataaccaaaaaaataaggagc

SEQ ID NO: 1391189 - DNA, 22 bp, Artificial Sequence
  chemically synthesized
ataagcggctccttattttttt

SEQ ID NO: 1391190 - DNA, 22 bp, Artificial Sequence
  chemically synthesized
gattttataaccaaaaaaataa

SEQ ID NO: 1391191 - DNA, 22 bp, Artificial Sequence
  chemically synthesized
tggattttataaccaaaaaaat

SEQ ID NO: 1391192 - DNA, 22 bp, Artificial Sequence
  chemically synthesized
gcattctggattttataaccaa

SEQ ID NO: 1391193 - DNA, 22 bp, Artificial Sequence
  chemically synthesized
agcattctggattttataacca

SEQ ID NO: 1391194 - DNA, 22 bp, Artificial Sequence
  chemically synthesized
cttatttttttggttataaaat

SEQ ID NO: 1391195 - DNA, 22 bp, Artificial Sequence
  chemically synthesized
atttttttggttataaaatcca

SEQ ID NO: 1391196 - DNA, 22 bp, Artificial Sequence
  chemically synthesized
tttttttggttataaaatccag

SEQ ID NO: 1391197 - DNA, 22 bp, Artificial Sequence
  chemically synthesized
gtgtttagcattctggatttta

SEQ ID NO: 1391198 - DNA, 22 bp, Artificial Sequence
  chemically synthesized
ttttggttataaaatccagaat

SEQ ID NO: 1391199 - DNA, 22 bp, Artificial Sequence
  chemically synthesized
tttggttataaaatccagaatg

SEQ ID NO: 1391200 - DNA, 22 bp, Artificial Sequence
  chemically synthesized
ttggttataaaatccagaatgc

SEQ ID NO: 1391201 - DNA, 22 bp, Artificial Sequence
  chemically synthesized
tggttataaaatccagaatgct

SEQ ID NO: 1391202 - DNA, 22 bp, Artificial Sequence
  chemically synthesized
tagttcgtgtttagcattctgg

SEQ ID NO: 1391203 - DNA, 22 bp, Artificial Sequence
  chemically synthesized
ggttataaaatccagaatgcta

SEQ ID NO: 1391204 - DNA, 22 bp, Artificial Sequence
  chemically synthesized
gttataaaatccagaatgctaa

SEQ ID NO: 1391205 - DNA, 22 bp, Artificial Sequence
  chemically synthesized
taaaatccagaatgctaaacac

SEQ ID NO: 1391206 - DNA, 22 bp, Artificial Sequence
  chemically synthesized
atgcagcatcctatagttcgtg

SEQ ID NO: 1391207 - DNA, 22 bp, Artificial Sequence
  chemically synthesized
cctcatgcagcatcctatagtt

SEQ ID NO: 1391208 - DNA, 22 bp, Artificial Sequence
  chemically synthesized
aacacgaactataggatgctgc

SEQ ID NO: 1391209 - DNA, 22 bp, Artificial Sequence
  chemically synthesized
taggatgctgcatgaggtaatc

SEQ ID NO: 1391210 - DNA, 22 bp, Artificial Sequence
  chemically synthesized
ggggagatatgtaaacagggat

SEQ ID NO: 1391211 - DNA, 22 bp, Artificial Sequence
  chemically synthesized
catgaggtaatccctgtttaca

SEQ ID NO: 1391212 - DNA, 22 bp, Artificial Sequence
  chemically synthesized
tttacatatctcccccaaccca

SEQ ID NO: 1391213 - DNA, 22 bp, Artificial Sequence
  chemically synthesized
acatatctcccccaacccatgt

SEQ ID NO: 1391214 - DNA, 22 bp, Artificial Sequence
  chemically synthesized
catatctcccccaacccatgtt

SEQ ID NO: 1391215 - DNA, 22 bp, Artificial Sequence
  chemically synthesized
ccccaacccatgttgattcatt

SEQ ID NO: 1391216 - DNA, 22 bp, Artificial Sequence
  chemically synthesized
gaatgaggaaagatgaatgaat

SEQ ID NO: 1391217 - DNA, 22 bp, Artificial Sequence
  chemically synthesized
attcattcatctttcctcattc

SEQ ID NO: 1391218 - DNA, 22 bp, Artificial Sequence
  chemically synthesized
attcatctttcctcattctagc

SEQ ID NO: 1391219 - DNA, 22 bp, Artificial Sequence
  chemically synthesized
aagtcaagcacagctagaatga

SEQ ID NO: 1391220 - DNA, 22 bp, Artificial Sequence
  chemically synthesized
atctttcctcattctagctgtg

SEQ ID NO: 1391221 - DNA, 22 bp, Artificial Sequence
  chemically synthesized
aggaactaaagtcaagcacagc

SEQ ID NO: 1391222 - DNA, 22 bp, Artificial Sequence
  chemically synthesized
tcctcattctagctgtgcttga

SEQ ID NO: 1391223 - DNA, 22 bp, Artificial Sequence
  chemically synthesized
gaggaactaaagtcaagcacag

SEQ ID NO: 1391224 - DNA, 22 bp, Artificial Sequence
  chemically synthesized
cctcattctagctgtgcttgac

SEQ ID NO: 1391225 - DNA, 22 bp, Artificial Sequence
  chemically synthesized
ctcattctagctgtgcttgact

SEQ ID NO: 1391226 - DNA, 22 bp, Artificial Sequence
  chemically synthesized
attctagctgtgcttgacttta

SEQ ID NO: 1391227 - DNA, 22 bp, Artificial Sequence
  chemically synthesized
tagctgtgcttgactttagttc

SEQ ID NO: 1391228 - DNA, 22 bp, Artificial Sequence
  chemically synthesized
gctgtgcttgactttagttcct

SEQ ID NO: 1391229 - DNA, 22 bp, Artificial Sequence
  chemically synthesized
tgcttgactttagttcctcaaa

SEQ ID NO: 1391230 - DNA, 22 bp, Artificial Sequence
  chemically synthesized
gactttagttcctcaaatatac

SEQ ID NO: 1391231 - DNA, 22 bp, Artificial Sequence
  chemically synthesized
actttagttcctcaaatatact

SEQ ID NO: 1391232 - DNA, 22 bp, Artificial Sequence
  chemically synthesized
agacataaagaagcaagtatat

SEQ ID NO: 1391233 - DNA, 22 bp, Artificial Sequence
  chemically synthesized
tagttcctcaaatatacttgct

SEQ ID NO: 1391234 - DNA, 22 bp, Artificial Sequence
  chemically synthesized
agttcctcaaatatacttgctt

SEQ ID NO: 1391235 - DNA, 22 bp, Artificial Sequence
  chemically synthesized
gttcctcaaatatacttgcttc

SEQ ID NO: 1391236 - DNA, 22 bp, Artificial Sequence
  chemically synthesized
ctcaaatatacttgcttcttta

SEQ ID NO: 1391237 - DNA, 22 bp, Artificial Sequence
  chemically synthesized
aagacctgagacataaagaagc

SEQ ID NO: 1391238 - DNA, 22 bp, Artificial Sequence
  chemically synthesized
aaatatacttgcttctttatgt

SEQ ID NO: 1391239 - DNA, 22 bp, Artificial Sequence
  chemically synthesized
gcttctttatgtctcaggtctt

SEQ ID NO: 1391240 - DNA, 22 bp, Artificial Sequence
  chemically synthesized
cttctttatgtctcaggtcttt

SEQ ID NO: 1391241 - DNA, 22 bp, Artificial Sequence
  chemically synthesized
ctttatgtctcaggtctttaat

SEQ ID NO: 1391242 - DNA, 22 bp, Artificial Sequence
  chemically synthesized
tttatgtctcaggtctttaata

SEQ ID NO: 1391243 - DNA, 22 bp, Artificial Sequence
  chemically synthesized
tatagcatgcatgtattaaaga

SEQ ID NO: 1391244 - DNA, 22 bp, Artificial Sequence
  chemically synthesized
tatgtctcaggtctttaataca

SEQ ID NO: 1391245 - DNA, 22 bp, Artificial Sequence
  chemically synthesized
gtatagcatgcatgtattaaag

SEQ ID NO: 1391246 - DNA, 22 bp, Artificial Sequence
  chemically synthesized
atgtctcaggtctttaatacat

SEQ ID NO: 1391247 - DNA, 22 bp, Artificial Sequence
  chemically synthesized
tgtctcaggtctttaatacatg

SEQ ID NO: 1391248 - DNA, 22 bp, Artificial Sequence
  chemically synthesized
gcttgtatagcatgcatgtatt

SEQ ID NO: 1391249 - DNA, 22 bp, Artificial Sequence
  chemically synthesized
tggcttgtatagcatgcatgta

SEQ ID NO: 1391250 - DNA, 22 bp, Artificial Sequence
  chemically synthesized
ctggcttgtatagcatgcatgt

SEQ ID NO: 1391251 - DNA, 22 bp, Artificial Sequence
  chemically synthesized
aggtctttaatacatgcatgct

SEQ ID NO: 1391252 - DNA, 22 bp, Artificial Sequence
  chemically synthesized
tctggcttgtatagcatgcatg

SEQ ID NO: 1391253 - DNA, 22 bp, Artificial Sequence
  chemically synthesized
taatacatgcatgctatacaag

SEQ ID NO: 1391254 - DNA, 22 bp, Artificial Sequence
  chemically synthesized
aatacatgcatgctatacaagc

SEQ ID NO: 1391255 - DNA, 22 bp, Artificial Sequence
  chemically synthesized
atacatgcatgctatacaagcc

SEQ ID NO: 1391256 - DNA, 22 bp, Artificial Sequence
  chemically synthesized
agggtggtggtaagatgttttc

SEQ ID NO: 1391257 - DNA, 22 bp, Artificial Sequence
  chemically synthesized
gagggtggtggtaagatgtttt

SEQ ID NO: 1391258 - DNA, 22 bp, Artificial Sequence
  chemically synthesized
tacaagccagaaaacatcttac

SEQ ID NO: 1391259 - DNA, 22 bp, Artificial Sequence
  chemically synthesized
cttgagggtggtggtaagatgt

SEQ ID NO: 1391260 - DNA, 22 bp, Artificial Sequence
  chemically synthesized
tattacttgagggtggtggtaa

SEQ ID NO: 1391261 - DNA, 22 bp, Artificial Sequence
  chemically synthesized
atattacttgagggtggtggta

SEQ ID NO: 1391262 - DNA, 22 bp, Artificial Sequence
  chemically synthesized
gtttatattacttgagggtggt

SEQ ID NO: 1391263 - DNA, 22 bp, Artificial Sequence
  chemically synthesized
tctagtttatattacttgaggg

SEQ ID NO: 1391264 - DNA, 22 bp, Artificial Sequence
  chemically synthesized
gtctagtttatattacttgagg

SEQ ID NO: 1391265 - DNA, 22 bp, Artificial Sequence
  chemically synthesized
accaccaccctcaagtaatata

SEQ ID NO: 1391266 - DNA, 22 bp, Artificial Sequence
  chemically synthesized
ccaccaccctcaagtaatataa

SEQ ID NO: 1391267 - DNA, 22 bp, Artificial Sequence
  chemically synthesized
tatgcacttgtctagtttatat

SEQ ID NO: 1391268 - DNA, 22 bp, Artificial Sequence
  chemically synthesized
aagtaatataaactagacaagt

SEQ ID NO: 1391269 - DNA, 22 bp, Artificial Sequence
  chemically synthesized
aagacattgtatgcacttgtct

SEQ ID NO: 1391270 - DNA, 22 bp, Artificial Sequence
  chemically synthesized
accaggaattaaagacattgta

SEQ ID NO: 1391271 - DNA, 22 bp, Artificial Sequence
  chemically synthesized
gacaagtgcatacaatgtcttt

SEQ ID NO: 1391272 - DNA, 22 bp, Artificial Sequence
  chemically synthesized
aagataaaaattgaccaggaat

SEQ ID NO: 1391273 - DNA, 22 bp, Artificial Sequence
  chemically synthesized
gaagataaaaattgaccaggaa

SEQ ID NO: 1391274 - DNA, 22 bp, Artificial Sequence
  chemically synthesized
acttgaagataaaaattgacca

SEQ ID NO: 1391275 - DNA, 22 bp, Artificial Sequence
  chemically synthesized
taattcctggtcaatttttatc

SEQ ID NO: 1391276 - DNA, 22 bp, Artificial Sequence
  chemically synthesized
aattcctggtcaatttttatct

SEQ ID NO: 1391277 - DNA, 22 bp, Artificial Sequence
  chemically synthesized
attcctggtcaatttttatctt

SEQ ID NO: 1391278 - DNA, 22 bp, Artificial Sequence
  chemically synthesized
ctggtcaatttttatcttcaag

SEQ ID NO: 1391279 - DNA, 22 bp, Artificial Sequence
  chemically synthesized
tagtaaagttcacttgaagata

SEQ ID NO: 1391280 - DNA, 22 bp, Artificial Sequence
  chemically synthesized
atagtaaagttcacttgaagat

SEQ ID NO: 1391281 - DNA, 22 bp, Artificial Sequence
  chemically synthesized
gtcaatttttatcttcaagtga

SEQ ID NO: 1391282 - DNA, 22 bp, Artificial Sequence
  chemically synthesized
acttatagtaaagttcacttga

SEQ ID NO: 1391283 - DNA, 22 bp, Artificial Sequence
  chemically synthesized
cacttatagtaaagttcacttg

SEQ ID NO: 1391284 - DNA, 22 bp, Artificial Sequence
  chemically synthesized
tcacttatagtaaagttcactt

SEQ ID NO: 1391285 - DNA, 22 bp, Artificial Sequence
  chemically synthesized
ttatcttcaagtgaactttact

SEQ ID NO: 1391286 - DNA, 22 bp, Artificial Sequence
  chemically synthesized
tatcttcaagtgaactttacta

SEQ ID NO: 1391287 - DNA, 22 bp, Artificial Sequence
  chemically synthesized
atcttcaagtgaactttactat

SEQ ID NO: 1391288 - DNA, 22 bp, Artificial Sequence
  chemically synthesized
tcttcaagtgaactttactata

SEQ ID NO: 1391289 - DNA, 22 bp, Artificial Sequence
  chemically synthesized
caagtgaactttactataagtg

SEQ ID NO: 1391290 - DNA, 22 bp, Artificial Sequence
  chemically synthesized
aagtgaactttactataagtga

SEQ ID NO: 1391291 - DNA, 22 bp, Artificial Sequence
  chemically synthesized
tactataagtgaaagcttttgt

SEQ ID NO: 1391292 - DNA, 22 bp, Artificial Sequence
  chemically synthesized
actataagtgaaagcttttgtt

SEQ ID NO: 1391293 - DNA, 22 bp, Artificial Sequence
  chemically synthesized
ctataagtgaaagcttttgttt

SEQ ID NO: 1391294 - DNA, 22 bp, Artificial Sequence
  chemically synthesized
taagtgaaagcttttgtttgct

SEQ ID NO: 1391295 - DNA, 22 bp, Artificial Sequence
  chemically synthesized
tgaccatgtataaatcaagcaa

SEQ ID NO: 1391296 - DNA, 22 bp, Artificial Sequence
  chemically synthesized
gtgaccatgtataaatcaagca

SEQ ID NO: 1391297 - DNA, 22 bp, Artificial Sequence
  chemically synthesized
tgtgaccatgtataaatcaagc

SEQ ID NO: 1391298 - DNA, 22 bp, Artificial Sequence
  chemically synthesized
ttttgtgaccatgtataaatca

SEQ ID NO: 1391299 - DNA, 22 bp, Artificial Sequence
  chemically synthesized
attttgtgaccatgtataaatc

SEQ ID NO: 1391300 - DNA, 22 bp, Artificial Sequence
  chemically synthesized
ttgtttgcttgatttatacatg

SEQ ID NO: 1391301 - DNA, 22 bp, Artificial Sequence
  chemically synthesized
tgtttgcttgatttatacatgg

SEQ ID NO: 1391302 - DNA, 22 bp, Artificial Sequence
  chemically synthesized
gtttgcttgatttatacatggt

SEQ ID NO: 1391303 - DNA, 22 bp, Artificial Sequence
  chemically synthesized
tttgcttgatttatacatggtc

SEQ ID NO: 1391304 - DNA, 22 bp, Artificial Sequence
  chemically synthesized
gcagcttattttgtgaccatgt

SEQ ID NO: 1391305 - DNA, 22 bp, Artificial Sequence
  chemically synthesized
gcttgatttatacatggtcaca

SEQ ID NO: 1391306 - DNA, 22 bp, Artificial Sequence
  chemically synthesized
cttgatttatacatggtcacaa

SEQ ID NO: 1391307 - DNA, 22 bp, Artificial Sequence
  chemically synthesized
tggcagcttattttgtgaccat

SEQ ID NO: 1391308 - DNA, 22 bp, Artificial Sequence
  chemically synthesized
ctggcagcttattttgtgacca

SEQ ID NO: 1391309 - DNA, 22 bp, Artificial Sequence
  chemically synthesized
tctggcagcttattttgtgacc

SEQ ID NO: 1391310 - DNA, 22 bp, Artificial Sequence
  chemically synthesized
gatttatacatggtcacaaaat

SEQ ID NO: 1391311 - DNA, 22 bp, Artificial Sequence
  chemically synthesized
atttatacatggtcacaaaata

SEQ ID NO: 1391312 - DNA, 22 bp, Artificial Sequence
  chemically synthesized
gactttctggcagcttattttg

SEQ ID NO: 1391313 - DNA, 22 bp, Artificial Sequence
  chemically synthesized
atacatggtcacaaaataagct

SEQ ID NO: 1391314 - DNA, 22 bp, Artificial Sequence
  chemically synthesized
tacatggtcacaaaataagctg

SEQ ID NO: 1391315 - DNA, 22 bp, Artificial Sequence
  chemically synthesized
ggaggaaagaaattcgactttc

SEQ ID NO: 1391316 - DNA, 22 bp, Artificial Sequence
  chemically synthesized
agctaggaggaaagaaattcga

SEQ ID NO: 1391317 - DNA, 22 bp, Artificial Sequence
  chemically synthesized
aagctaggaggaaagaaattcg

SEQ ID NO: 1391318 - DNA, 22 bp, Artificial Sequence
  chemically synthesized
taagctaggaggaaagaaattc

SEQ ID NO: 1391319 - DNA, 22 bp, Artificial Sequence
  chemically synthesized
ttaagctaggaggaaagaaatt

SEQ ID NO: 1391320 - DNA, 22 bp, Artificial Sequence
  chemically synthesized
ccagaaagtcgaatttctttcc

SEQ ID NO: 1391321 - DNA, 22 bp, Artificial Sequence
  chemically synthesized
ctttcctcctagcttaaaaata

SEQ ID NO: 1391322 - DNA, 22 bp, Artificial Sequence
  chemically synthesized
tttcctcctagcttaaaaatac

SEQ ID NO: 1391323 - DNA, 22 bp, Artificial Sequence
  chemically synthesized
tcctcctagcttaaaaatacat

SEQ ID NO: 1391324 - DNA, 22 bp, Artificial Sequence
  chemically synthesized
cctcctagcttaaaaatacatc

SEQ ID NO: 1391325 - DNA, 22 bp, Artificial Sequence
  chemically synthesized
ctcctagcttaaaaatacatct

SEQ ID NO: 1391326 - DNA, 22 bp, Artificial Sequence
  chemically synthesized
ctagcttaaaaatacatctacc

SEQ ID NO: 1391327 - DNA, 22 bp, Artificial Sequence
  chemically synthesized
aggatgaaggaggggtagatgt

SEQ ID NO: 1391328 - DNA, 22 bp, Artificial Sequence
  chemically synthesized
aaggatgaaggaggggtagatg

SEQ ID NO: 1391329 - DNA, 22 bp, Artificial Sequence
  chemically synthesized
gcttaaaaatacatctacccct

SEQ ID NO: 1391330 - DNA, 22 bp, Artificial Sequence
  chemically synthesized
taaggatgaaggaggggtagat

SEQ ID NO: 1391331 - DNA, 22 bp, Artificial Sequence
  chemically synthesized
ttaaggatgaaggaggggtaga

SEQ ID NO: 1391332 - DNA, 22 bp, Artificial Sequence
  chemically synthesized
tttaaggatgaaggaggggtag

SEQ ID NO: 1391333 - DNA, 22 bp, Artificial Sequence
  chemically synthesized
ttttaaggatgaaggaggggta

SEQ ID NO: 1391334 - DNA, 22 bp, Artificial Sequence
  chemically synthesized
aaaaatacatctacccctcctt

SEQ ID NO: 1391335 - DNA, 22 bp, Artificial Sequence
  chemically synthesized
aaaatacatctacccctccttc

SEQ ID NO: 1391336 - DNA, 22 bp, Artificial Sequence
  chemically synthesized
ttttttaaggatgaaggagggg

SEQ ID NO: 1391337 - DNA, 22 bp, Artificial Sequence
  chemically synthesized
cttttttaaggatgaaggaggg

SEQ ID NO: 1391338 - DNA, 22 bp, Artificial Sequence
  chemically synthesized
tcttttttaaggatgaaggagg

SEQ ID NO: 1391339 - DNA, 22 bp, Artificial Sequence
  chemically synthesized
cccctccttcatccttaaaaaa

SEQ ID NO: 1391340 - DNA, 22 bp, Artificial Sequence
  chemically synthesized
tgaagatgcattttctttttta

SEQ ID NO: 1391341 - DNA, 22 bp, Artificial Sequence
  chemically synthesized
atgaagatgcattttctttttt

SEQ ID NO: 1391342 - DNA, 22 bp, Artificial Sequence
  chemically synthesized
tatgaagatgcattttcttttt

SEQ ID NO: 1391343 - DNA, 22 bp, Artificial Sequence
  chemically synthesized
cttcatccttaaaaaagaaaat

SEQ ID NO: 1391344 - DNA, 22 bp, Artificial Sequence
  chemically synthesized
ttatgaagatgcattttctttt

SEQ ID NO: 1391345 - DNA, 22 bp, Artificial Sequence
  chemically synthesized
tttatgaagatgcattttcttt

SEQ ID NO: 1391346 - DNA, 22 bp, Artificial Sequence
  chemically synthesized
catccttaaaaaagaaaatgca

SEQ ID NO: 1391347 - DNA, 22 bp, Artificial Sequence
  chemically synthesized
atccttaaaaaagaaaatgcat

SEQ ID NO: 1391348 - DNA, 22 bp, Artificial Sequence
  chemically synthesized
taatctttttatgaagatgcat

SEQ ID NO: 1391349 - DNA, 22 bp, Artificial Sequence
  chemically synthesized
aaaaaagaaaatgcatcttcat

SEQ ID NO: 1391350 - DNA, 22 bp, Artificial Sequence
  chemically synthesized
aaaaagaaaatgcatcttcata

SEQ ID NO: 1391351 - DNA, 22 bp, Artificial Sequence
  chemically synthesized
aaaagttgtaatctttttatga

SEQ ID NO: 1391352 - DNA, 22 bp, Artificial Sequence
  chemically synthesized
tattcaaaagttgtaatctttt

SEQ ID NO: 1391353 - DNA, 22 bp, Artificial Sequence
  chemically synthesized
atattcaaaagttgtaatcttt

SEQ ID NO: 1391354 - DNA, 22 bp, Artificial Sequence
  chemically synthesized
tatattcaaaagttgtaatctt

SEQ ID NO: 1391355 - DNA, 22 bp, Artificial Sequence
  chemically synthesized
ttatattcaaaagttgtaatct

SEQ ID NO: 1391356 - DNA, 22 bp, Artificial Sequence
  chemically synthesized
cataaaaagattacaacttttg

SEQ ID NO: 1391357 - DNA, 22 bp, Artificial Sequence
  chemically synthesized
ataaaaagattacaacttttga

SEQ ID NO: 1391358 - DNA, 22 bp, Artificial Sequence
  chemically synthesized
aaaaacatgacttttatattca

SEQ ID NO: 1391359 - DNA, 22 bp, Artificial Sequence
  chemically synthesized
gaaaaacatgacttttatattc

SEQ ID NO: 1391360 - DNA, 22 bp, Artificial Sequence
  chemically synthesized
tttgaaaaacatgacttttata

SEQ ID NO: 1391361 - DNA, 22 bp, Artificial Sequence
  chemically synthesized
caacttttgaatataaaagtca

SEQ ID NO: 1391362 - DNA, 22 bp, Artificial Sequence
  chemically synthesized
ttgaatataaaagtcatgtttt

SEQ ID NO: 1391363 - DNA, 22 bp, Artificial Sequence
  chemically synthesized
tgaatataaaagtcatgttttt

SEQ ID NO: 1391364 - DNA, 22 bp, Artificial Sequence
  chemically synthesized
gaatataaaagtcatgtttttc

SEQ ID NO: 1391365 - DNA, 22 bp, Artificial Sequence
  chemically synthesized
aatataaaagtcatgtttttca

SEQ ID NO: 1391366 - DNA, 22 bp, Artificial Sequence
  chemically synthesized
agaatatatccgttgtttgaaa

SEQ ID NO: 1391367 - DNA, 22 bp, Artificial Sequence
  chemically synthesized
ttcaaacaacggatatattctc

SEQ ID NO: 1391368 - DNA, 22 bp, Artificial Sequence
  chemically synthesized
tcaaacaacggatatattctca

SEQ ID NO: 1391369 - DNA, 22 bp, Artificial Sequence
  chemically synthesized
caaacaacggatatattctcaa

SEQ ID NO: 1391370 - DNA, 22 bp, Artificial Sequence
  chemically synthesized
aaacaacggatatattctcaac

SEQ ID NO: 1391371 - DNA, 22 bp, Artificial Sequence
  chemically synthesized
gtgggaaatacatatatgttga

SEQ ID NO: 1391372 - DNA, 22 bp, Artificial Sequence
  chemically synthesized
ataattggtgggaaatacatat

SEQ ID NO: 1391373 - DNA, 22 bp, Artificial Sequence
  chemically synthesized
tcaacatatatgtatttcccac

SEQ ID NO: 1391374 - DNA, 22 bp, Artificial Sequence
  chemically synthesized
tgtctcataattggtgggaaat

SEQ ID NO: 1391375 - DNA, 22 bp, Artificial Sequence
  chemically synthesized
aacatatatgtatttcccacca

SEQ ID NO: 1391376 - DNA, 22 bp, Artificial Sequence
  chemically synthesized
ttgtgtctcataattggtggga

SEQ ID NO: 1391377 - DNA, 22 bp, Artificial Sequence
  chemically synthesized
gttgtgtctcataattggtggg

SEQ ID NO: 1391378 - DNA, 22 bp, Artificial Sequence
  chemically synthesized
tgttgtgtctcataattggtgg

SEQ ID NO: 1391379 - DNA, 22 bp, Artificial Sequence
  chemically synthesized
ttgttgtgtctcataattggtg

SEQ ID NO: 1391380 - DNA, 22 bp, Artificial Sequence
  chemically synthesized
tttgttgtgtctcataattggt

SEQ ID NO: 1391381 - DNA, 22 bp, Artificial Sequence
  chemically synthesized
ttttgttgtgtctcataattgg

SEQ ID NO: 1391382 - DNA, 22 bp, Artificial Sequence
  chemically synthesized
tttttgttgtgtctcataattg

SEQ ID NO: 1391383 - DNA, 22 bp, Artificial Sequence
  chemically synthesized
tttttttgttgtgtctcataat

SEQ ID NO: 1391384 - DNA, 22 bp, Artificial Sequence
  chemically synthesized
ctttttttgttgtgtctcataa

SEQ ID NO: 1391385 - DNA, 22 bp, Artificial Sequence
  chemically synthesized
tctttttttgttgtgtctcata

SEQ ID NO: 1391386 - DNA, 22 bp, Artificial Sequence
  chemically synthesized
cccaccaattatgagacacaac

SEQ ID NO: 1391387 - DNA, 22 bp, Artificial Sequence
  chemically synthesized
ccaccaattatgagacacaaca

SEQ ID NO: 1391388 - DNA, 22 bp, Artificial Sequence
  chemically synthesized
aaattttctttttttgttgtgt

SEQ ID NO: 1391389 - DNA, 22 bp, Artificial Sequence
  chemically synthesized
gcctgaaattttctttttttgt

SEQ ID NO: 1391390 - DNA, 22 bp, Artificial Sequence
  chemically synthesized
tgagacacaacaaaaaaagaaa

SEQ ID NO: 1391391 - DNA, 22 bp, Artificial Sequence
  chemically synthesized
atcagggatattggcctgaaat

SEQ ID NO: 1391392 - DNA, 22 bp, Artificial Sequence
  chemically synthesized
atgttcatcagggatattggcc

SEQ ID NO: 1391393 - DNA, 22 bp, Artificial Sequence
  chemically synthesized
cattgatgttcatcagggatat

SEQ ID NO: 1391394 - DNA, 22 bp, Artificial Sequence
  chemically synthesized
gcattgatgttcatcagggata

SEQ ID NO: 1391395 - DNA, 22 bp, Artificial Sequence
  chemically synthesized
tgcattgatgttcatcagggat

SEQ ID NO: 1391396 - DNA, 22 bp, Artificial Sequence
  chemically synthesized
ttgcattgatgttcatcaggga

SEQ ID NO: 1391397 - DNA, 22 bp, Artificial Sequence
  chemically synthesized
caggccaatatccctgatgaac

SEQ ID NO: 1391398 - DNA, 22 bp, Artificial Sequence
  chemically synthesized
aggccaatatccctgatgaaca

SEQ ID NO: 1391399 - DNA, 22 bp, Artificial Sequence
  chemically synthesized
aggatttttgcattgatgttca

SEQ ID NO: 1391400 - DNA, 22 bp, Artificial Sequence
  chemically synthesized
ttgaggatttttgcattgatgt

SEQ ID NO: 1391401 - DNA, 22 bp, Artificial Sequence
  chemically synthesized
attgaggatttttgcattgatg

SEQ ID NO: 1391402 - DNA, 22 bp, Artificial Sequence
  chemically synthesized
tattgaggatttttgcattgat

SEQ ID NO: 1391403 - DNA, 22 bp, Artificial Sequence
  chemically synthesized
atgaacatcaatgcaaaaatcc

SEQ ID NO: 1391404 - DNA, 22 bp, Artificial Sequence
  chemically synthesized
ccagtattttattgaggatttt

SEQ ID NO: 1391405 - DNA, 22 bp, Artificial Sequence
  chemically synthesized
gccagtattttattgaggattt

SEQ ID NO: 1391406 - DNA, 22 bp, Artificial Sequence
  chemically synthesized
agtttgccagtattttattgag

SEQ ID NO: 1391407 - DNA, 22 bp, Artificial Sequence
  chemically synthesized
gattcagtttgccagtatttta

SEQ ID NO: 1391408 - DNA, 22 bp, Artificial Sequence
  chemically synthesized
ctggattcagtttgccagtatt

SEQ ID NO: 1391409 - DNA, 22 bp, Artificial Sequence
  chemically synthesized
aataaaatactggcaaactgaa

SEQ ID NO: 1391410 - DNA, 22 bp, Artificial Sequence
  chemically synthesized
atgtgctgctggattcagtttg

SEQ ID NO: 1391411 - DNA, 22 bp, Artificial Sequence
  chemically synthesized
gatgtgctgctggattcagttt

SEQ ID NO: 1391412 - DNA, 22 bp, Artificial Sequence
  chemically synthesized
tgatgtgctgctggattcagtt

SEQ ID NO: 1391413 - DNA, 22 bp, Artificial Sequence
  chemically synthesized
ttgatgtgctgctggattcagt

SEQ ID NO: 1391414 - DNA, 22 bp, Artificial Sequence
  chemically synthesized
tttgatgtgctgctggattcag

SEQ ID NO: 1391415 - DNA, 22 bp, Artificial Sequence
  chemically synthesized
gcaaactgaatccagcagcaca

SEQ ID NO: 1391416 - DNA, 22 bp, Artificial Sequence
  chemically synthesized
aatccagcagcacatcaaaaag

SEQ ID NO: 1391417 - DNA, 22 bp, Artificial Sequence
  chemically synthesized
atcgtggtgggtaagctttttg

SEQ ID NO: 1391418 - DNA, 22 bp, Artificial Sequence
  chemically synthesized
aatcgtggtgggtaagcttttt

SEQ ID NO: 1391419 - DNA, 22 bp, Artificial Sequence
  chemically synthesized
ccagggatgaagtcgacttaat

SEQ ID NO: 1391420 - DNA, 22 bp, Artificial Sequence
  chemically synthesized
cccagggatgaagtcgacttaa

SEQ ID NO: 1391421 - DNA, 22 bp, Artificial Sequence
  chemically synthesized
acccaccacgattaagtcgact

SEQ ID NO: 1391422 - DNA, 22 bp, Artificial Sequence
  chemically synthesized
cccaccacgattaagtcgactt

SEQ ID NO: 1391423 - DNA, 22 bp, Artificial Sequence
  chemically synthesized
cttcccagggatgaagtcgact

SEQ ID NO: 1391424 - DNA, 22 bp, Artificial Sequence
  chemically synthesized
gcttcccagggatgaagtcgac

SEQ ID NO: 1391425 - DNA, 22 bp, Artificial Sequence
  chemically synthesized
aaccagccttgcttcccaggga

SEQ ID NO: 1391426 - DNA, 22 bp, Artificial Sequence
  chemically synthesized
agtcgacttcatccctgggaag

SEQ ID NO: 1391427 - DNA, 22 bp, Artificial Sequence
  chemically synthesized
catgtgttgaaccagccttgct

SEQ ID NO: 1391428 - DNA, 22 bp, Artificial Sequence
  chemically synthesized
catccctgggaagcaaggctgg

SEQ ID NO: 1391429 - DNA, 22 bp, Artificial Sequence
  chemically synthesized
gcatgtgttgaaccagccttgc

SEQ ID NO: 1391430 - DNA, 22 bp, Artificial Sequence
  chemically synthesized
atccctgggaagcaaggctggt

SEQ ID NO: 1391431 - DNA, 22 bp, Artificial Sequence
  chemically synthesized
atttgcatgtgttgaaccagcc

SEQ ID NO: 1391432 - DNA, 22 bp, Artificial Sequence
  chemically synthesized
ttgatttgcatgtgttgaacca

SEQ ID NO: 1391433 - DNA, 22 bp, Artificial Sequence
  chemically synthesized
ggaagcaaggctggttcaacac

SEQ ID NO: 1391434 - DNA, 22 bp, Artificial Sequence
  chemically synthesized
attgatttgcatgtgttgaacc

SEQ ID NO: 1391435 - DNA, 22 bp, Artificial Sequence
  chemically synthesized
tgtttattgatttgcatgtgtt

SEQ ID NO: 1391436 - DNA, 22 bp, Artificial Sequence
  chemically synthesized
gattatgtttattgatttgcat

SEQ ID NO: 1391437 - DNA, 22 bp, Artificial Sequence
  chemically synthesized
gttcaacacatgcaaatcaata

SEQ ID NO: 1391438 - DNA, 22 bp, Artificial Sequence
  chemically synthesized
aacacatgcaaatcaataaaca

SEQ ID NO: 1391439 - DNA, 22 bp, Artificial Sequence
  chemically synthesized
tgtgctggattatgtttattga

SEQ ID NO: 1391440 - DNA, 22 bp, Artificial Sequence
  chemically synthesized
atgtgctggattatgtttattg

SEQ ID NO: 1391441 - DNA, 22 bp, Artificial Sequence
  chemically synthesized
tttatgtgctggattatgttta

SEQ ID NO: 1391442 - DNA, 22 bp, Artificial Sequence
  chemically synthesized
gtgctgtttatgtgctggatta

SEQ ID NO: 1391443 - DNA, 22 bp, Artificial Sequence
  chemically synthesized
tcattggtgctgtttatgtgct

SEQ ID NO: 1391444 - DNA, 22 bp, Artificial Sequence
  chemically synthesized
gtcattggtgctgtttatgtgc

SEQ ID NO: 1391445 - DNA, 22 bp, Artificial Sequence
  chemically synthesized
tgtcattggtgctgtttatgtg

SEQ ID NO: 1391446 - DNA, 22 bp, Artificial Sequence
  chemically synthesized
ttgtcattggtgctgtttatgt

SEQ ID NO: 1391447 - DNA, 22 bp, Artificial Sequence
  chemically synthesized
agataatcgtagtttttgtcat

SEQ ID NO: 1391448 - DNA, 22 bp, Artificial Sequence
  chemically synthesized
ttgagataatcgtagtttttgt

SEQ ID NO: 1391449 - DNA, 22 bp, Artificial Sequence
  chemically synthesized
catctattgagataatcgtagt

SEQ ID NO: 1391450 - DNA, 22 bp, Artificial Sequence
  chemically synthesized
tgcatctattgagataatcgta

SEQ ID NO: 1391451 - DNA, 22 bp, Artificial Sequence
  chemically synthesized
ctgcatctattgagataatcgt

SEQ ID NO: 1391452 - DNA, 22 bp, Artificial Sequence
  chemically synthesized
tctgcatctattgagataatcg

SEQ ID NO: 1391453 - DNA, 22 bp, Artificial Sequence
  chemically synthesized
ttctgcatctattgagataatc

SEQ ID NO: 1391454 - DNA, 22 bp, Artificial Sequence
  chemically synthesized
cgattatctcaatagatgcaga

SEQ ID NO: 1391455 - DNA, 22 bp, Artificial Sequence
  chemically synthesized
tcgaaggccttttctgcatcta

SEQ ID NO: 1391456 - DNA, 22 bp, Artificial Sequence
  chemically synthesized
atcgaaggccttttctgcatct

SEQ ID NO: 1391457 - DNA, 22 bp, Artificial Sequence
  chemically synthesized
tatcgaaggccttttctgcatc

SEQ ID NO: 1391458 - DNA, 22 bp, Artificial Sequence
  chemically synthesized
tctcaatagatgcagaaaaggc

SEQ ID NO: 1391459 - DNA, 22 bp, Artificial Sequence
  chemically synthesized
aattttatcgaaggccttttct

SEQ ID NO: 1391460 - DNA, 22 bp, Artificial Sequence
  chemically synthesized
aatagatgcagaaaaggccttc

SEQ ID NO: 1391461 - DNA, 22 bp, Artificial Sequence
  chemically synthesized
gcatgaaggggtgttgaatttt

SEQ ID NO: 1391462 - DNA, 22 bp, Artificial Sequence
  chemically synthesized
agcatgaaggggtgttgaattt

SEQ ID NO: 1391463 - DNA, 22 bp, Artificial Sequence
  chemically synthesized
tagcatgaaggggtgttgaatt

SEQ ID NO: 1391464 - DNA, 22 bp, Artificial Sequence
  chemically synthesized
ttagcatgaaggggtgttgaat

SEQ ID NO: 1391465 - DNA, 22 bp, Artificial Sequence
  chemically synthesized
cgataaaattcaacaccccttc

SEQ ID NO: 1391466 - DNA, 22 bp, Artificial Sequence
  chemically synthesized
gataaaattcaacaccccttca

SEQ ID NO: 1391467 - DNA, 22 bp, Artificial Sequence
  chemically synthesized
agagtttttagcatgaaggggt

SEQ ID NO: 1391468 - DNA, 22 bp, Artificial Sequence
  chemically synthesized
ttaagagtttttagcatgaagg

SEQ ID NO: 1391469 - DNA, 22 bp, Artificial Sequence
  chemically synthesized
attaagagtttttagcatgaag

SEQ ID NO: 1391470 - DNA, 22 bp, Artificial Sequence
  chemically synthesized
gtttattaagagtttttagcat

SEQ ID NO: 1391471 - DNA, 22 bp, Artificial Sequence
  chemically synthesized
aacaccccttcatgctaaaaac

SEQ ID NO: 1391472 - DNA, 22 bp, Artificial Sequence
  chemically synthesized
catgctaaaaactcttaataaa

SEQ ID NO: 1391473 - DNA, 22 bp, Artificial Sequence
  chemically synthesized
atgctaaaaactcttaataaac

SEQ ID NO: 1391474 - DNA, 22 bp, Artificial Sequence
  chemically synthesized
caacaatacctagtttattaag

SEQ ID NO: 1391475 - DNA, 22 bp, Artificial Sequence
  chemically synthesized
aaaactcttaataaactaggta

SEQ ID NO: 1391476 - DNA, 22 bp, Artificial Sequence
  chemically synthesized
agatatactccaacaataccta

SEQ ID NO: 1391477 - DNA, 22 bp, Artificial Sequence
  chemically synthesized
aagatatactccaacaatacct

SEQ ID NO: 1391478 - DNA, 22 bp, Artificial Sequence
  chemically synthesized
taagatatactccaacaatacc

SEQ ID NO: 1391479 - DNA, 22 bp, Artificial Sequence
  chemically synthesized
ttaataaactaggtattgttgg

SEQ ID NO: 1391480 - DNA, 22 bp, Artificial Sequence
  chemically synthesized
aataaactaggtattgttggag

SEQ ID NO: 1391481 - DNA, 22 bp, Artificial Sequence
  chemically synthesized
ttttaagatatactccaacaat

SEQ ID NO: 1391482 - DNA, 22 bp, Artificial Sequence
  chemically synthesized
ataaactaggtattgttggagt

SEQ ID NO: 1391483 - DNA, 22 bp, Artificial Sequence
  chemically synthesized
ttgttttaagatatactccaac

SEQ ID NO: 1391484 - DNA, 22 bp, Artificial Sequence
  chemically synthesized
attgttttaagatatactccaa

SEQ ID NO: 1391485 - DNA, 22 bp, Artificial Sequence
  chemically synthesized
ttattgttttaagatatactcc

SEQ ID NO: 1391486 - DNA, 22 bp, Artificial Sequence
  chemically synthesized
ggtattgttggagtatatctta

SEQ ID NO: 1391487 - DNA, 22 bp, Artificial Sequence
  chemically synthesized
ttggagtatatcttaaaacaat

SEQ ID NO: 1391488 - DNA, 22 bp, Artificial Sequence
  chemically synthesized
gagtatatcttaaaacaataag

SEQ ID NO: 1391489 - DNA, 22 bp, Artificial Sequence
  chemically synthesized
tcataaatagctcttattgttt

SEQ ID NO: 1391490 - DNA, 22 bp, Artificial Sequence
  chemically synthesized
gtcataaatagctcttattgtt

SEQ ID NO: 1391491 - DNA, 22 bp, Artificial Sequence
  chemically synthesized
tgggtttgtcataaatagctct

SEQ ID NO: 1391492 - DNA, 22 bp, Artificial Sequence
  chemically synthesized
aaaacaataagagctatttatg

SEQ ID NO: 1391493 - DNA, 22 bp, Artificial Sequence
  chemically synthesized
aaacaataagagctatttatga

SEQ ID NO: 1391494 - DNA, 22 bp, Artificial Sequence
  chemically synthesized
tctgtgggtttgtcataaatag

SEQ ID NO: 1391495 - DNA, 22 bp, Artificial Sequence
  chemically synthesized
tgatattgtctgtgggtttgtc

SEQ ID NO: 1391496 - DNA, 22 bp, Artificial Sequence
  chemically synthesized
actatgatattgtctgtgggtt

SEQ ID NO: 1391497 - DNA, 22 bp, Artificial Sequence
  chemically synthesized
tttatgacaaacccacagacaa

SEQ ID NO: 1391498 - DNA, 22 bp, Artificial Sequence
  chemically synthesized
atgacaaacccacagacaatat

SEQ ID NO: 1391499 - DNA, 22 bp, Artificial Sequence
  chemically synthesized
tgacaaacccacagacaatatc

SEQ ID NO: 1391500 - DNA, 22 bp, Artificial Sequence
  chemically synthesized
cccattcactatgatattgtct

SEQ ID NO: 1391501 - DNA, 22 bp, Artificial Sequence
  chemically synthesized
gcccattcactatgatattgtc

SEQ ID NO: 1391502 - DNA, 22 bp, Artificial Sequence
  chemically synthesized
tgcccattcactatgatattgt

SEQ ID NO: 1391503 - DNA, 22 bp, Artificial Sequence
  chemically synthesized
ttgcccattcactatgatattg

SEQ ID NO: 1391504 - DNA, 22 bp, Artificial Sequence
  chemically synthesized
cagcttttgcccattcactatg

SEQ ID NO: 1391505 - DNA, 22 bp, Artificial Sequence
  chemically synthesized
ccagcttttgcccattcactat

SEQ ID NO: 1391506 - DNA, 22 bp, Artificial Sequence
  chemically synthesized
aaagtgaatgcttccagctttt

SEQ ID NO: 1391507 - DNA, 22 bp, Artificial Sequence
  chemically synthesized
caaagtgaatgcttccagcttt

SEQ ID NO: 1391508 - DNA, 22 bp, Artificial Sequence
  chemically synthesized
tcaaagtgaatgcttccagctt

SEQ ID NO: 1391509 - DNA, 22 bp, Artificial Sequence
  chemically synthesized
tgcgggttttcaaagtgaatgc

SEQ ID NO: 1391510 - DNA, 22 bp, Artificial Sequence
  chemically synthesized
gtgcgggttttcaaagtgaatg

SEQ ID NO: 1391511 - DNA, 22 bp, Artificial Sequence
  chemically synthesized
tcttgtgcgggttttcaaagtg

SEQ ID NO: 1391512 - DNA, 22 bp, Artificial Sequence
  chemically synthesized
gtcttgtgcgggttttcaaagt

SEQ ID NO: 1391513 - DNA, 22 bp, Artificial Sequence
  chemically synthesized
gaagcattcactttgaaaaccc

SEQ ID NO: 1391514 - DNA, 22 bp, Artificial Sequence
  chemically synthesized
actttgaaaacccgcacaagac

SEQ ID NO: 1391515 - DNA, 22 bp, Artificial Sequence
  chemically synthesized
tgaaaacccgcacaagacaagg

SEQ ID NO: 1391516 - DNA, 22 bp, Artificial Sequence
  chemically synthesized
gaaaacccgcacaagacaagga

SEQ ID NO: 1391517 - DNA, 22 bp, Artificial Sequence
  chemically synthesized
aaaacccgcacaagacaaggat

SEQ ID NO: 1391518 - DNA, 22 bp, Artificial Sequence
  chemically synthesized
aataggagtggtgagcgagggc

SEQ ID NO: 1391519 - DNA, 22 bp, Artificial Sequence
  chemically synthesized
tgttgaataggagtggtgagcg

SEQ ID NO: 1391520 - DNA, 22 bp, Artificial Sequence
  chemically synthesized
caatactatgttgaataggagt

SEQ ID NO: 1391521 - DNA, 22 bp, Artificial Sequence
  chemically synthesized
ccaatactatgttgaataggag

SEQ ID NO: 1391522 - DNA, 22 bp, Artificial Sequence
  chemically synthesized
gctcaccactcctattcaacat

SEQ ID NO: 1391523 - DNA, 22 bp, Artificial Sequence
  chemically synthesized
accactcctattcaacatagta

SEQ ID NO: 1391524 - DNA, 22 bp, Artificial Sequence
  chemically synthesized
gccagaacttccaatactatgt

SEQ ID NO: 1391525 - DNA, 22 bp, Artificial Sequence
  chemically synthesized
ctattcaacatagtattggaag

SEQ ID NO: 1391526 - DNA, 22 bp, Artificial Sequence
  chemically synthesized
ccctggccagaacttccaatac

SEQ ID NO: 1391527 - DNA, 22 bp, Artificial Sequence
  chemically synthesized
ttcaacatagtattggaagttc

SEQ ID NO: 1391528 - DNA, 22 bp, Artificial Sequence
  chemically synthesized
attgccctggccagaacttcca

SEQ ID NO: 1391529 - DNA, 22 bp, Artificial Sequence
  chemically synthesized
aacatagtattggaagttctgg

SEQ ID NO: 1391530 - DNA, 22 bp, Artificial Sequence
  chemically synthesized
cctgattgccctggccagaact

SEQ ID NO: 1391531 - DNA, 22 bp, Artificial Sequence
  chemically synthesized
gcctgattgccctggccagaac

SEQ ID NO: 1391532 - DNA, 22 bp, Artificial Sequence
  chemically synthesized
ttgcctgattgccctggccaga

SEQ ID NO: 1391533 - DNA, 22 bp, Artificial Sequence
  chemically synthesized
tcttgcctgattgccctggcca

SEQ ID NO: 1391534 - DNA, 22 bp, Artificial Sequence
  chemically synthesized
ctcttgcctgattgccctggcc

SEQ ID NO: 1391535 - DNA, 22 bp, Artificial Sequence
  chemically synthesized
tctcttgcctgattgccctggc

SEQ ID NO: 1391536 - DNA, 22 bp, Artificial Sequence
  chemically synthesized
tttctcttgcctgattgccctg

SEQ ID NO: 1391537 - DNA, 22 bp, Artificial Sequence
  chemically synthesized
gaagttctggccagggcaatca

SEQ ID NO: 1391538 - DNA, 22 bp, Artificial Sequence
  chemically synthesized
ctttctcttgcctgattgccct

SEQ ID NO: 1391539 - DNA, 22 bp, Artificial Sequence
  chemically synthesized
tttctttctcttgcctgattgc

SEQ ID NO: 1391540 - DNA, 22 bp, Artificial Sequence
  chemically synthesized
atttctttctcttgcctgattg

SEQ ID NO: 1391541 - DNA, 22 bp, Artificial Sequence
  chemically synthesized
tatttctttctcttgcctgatt

SEQ ID NO: 1391542 - DNA, 22 bp, Artificial Sequence
  chemically synthesized
tggccagggcaatcaggcaaga

SEQ ID NO: 1391543 - DNA, 22 bp, Artificial Sequence
  chemically synthesized
gccagggcaatcaggcaagaga

SEQ ID NO: 1391544 - DNA, 22 bp, Artificial Sequence
  chemically synthesized
aataccctttatttctttctct

SEQ ID NO: 1391545 - DNA, 22 bp, Artificial Sequence
  chemically synthesized
gaataccctttatttctttctc

SEQ ID NO: 1391546 - DNA, 22 bp, Artificial Sequence
  chemically synthesized
tttgaataccctttatttcttt

SEQ ID NO: 1391547 - DNA, 22 bp, Artificial Sequence
  chemically synthesized
ctatttgaataccctttatttc

SEQ ID NO: 1391548 - DNA, 22 bp, Artificial Sequence
  chemically synthesized
cctatttgaataccctttattt

SEQ ID NO: 1391549 - DNA, 22 bp, Artificial Sequence
  chemically synthesized
acttcctatttgaatacccttt

SEQ ID NO: 1391550 - DNA, 22 bp, Artificial Sequence
  chemically synthesized
gacttcctatttgaataccctt

SEQ ID NO: 1391551 - DNA, 22 bp, Artificial Sequence
  chemically synthesized
caaacagagacaatttgacttc

SEQ ID NO: 1391552 - DNA, 22 bp, Artificial Sequence
  chemically synthesized
aaataggaagtcaaattgtctc

SEQ ID NO: 1391553 - DNA, 22 bp, Artificial Sequence
  chemically synthesized
tctctgtttgcagatgacatgg

SEQ ID NO: 1391554 - DNA, 22 bp, Artificial Sequence
  chemically synthesized
tgtttgcagatgacatggctgc

SEQ ID NO: 1391555 - DNA, 22 bp, Artificial Sequence
  chemically synthesized
tttgcagatgacatggctgcca

SEQ ID NO: 1391556 - DNA, 22 bp, Artificial Sequence
  chemically synthesized
catggggataaatggcagccat

SEQ ID NO: 1391557 - DNA, 22 bp, Artificial Sequence
  chemically synthesized
gcagatgacatggctgccattt

SEQ ID NO: 1391558 - DNA, 22 bp, Artificial Sequence
  chemically synthesized
cagatgacatggctgccattta

SEQ ID NO: 1391559 - DNA, 22 bp, Artificial Sequence
  chemically synthesized
gaaggcattacatggggataaa

SEQ ID NO: 1391560 - DNA, 22 bp, Artificial Sequence
  chemically synthesized
ccatttatccccatgtaatgcc

SEQ ID NO: 1391561 - DNA, 22 bp, Artificial Sequence
  chemically synthesized
atccccatgtaatgccttctaa

SEQ ID NO: 1391562 - DNA, 22 bp, Artificial Sequence
  chemically synthesized
tccccatgtaatgccttctaat

SEQ ID NO: 1391563 - DNA, 22 bp, Artificial Sequence
  chemically synthesized
aagacaaaataacgagaacatc

SEQ ID NO: 1391564 - DNA, 22 bp, Artificial Sequence
  chemically synthesized
ctaatcacactgatgttctcgt

SEQ ID NO: 1391565 - DNA, 22 bp, Artificial Sequence
  chemically synthesized
taatcacactgatgttctcgtt

SEQ ID NO: 1391566 - DNA, 22 bp, Artificial Sequence
  chemically synthesized
atcacactgatgttctcgttat

SEQ ID NO: 1391567 - DNA, 22 bp, Artificial Sequence
  chemically synthesized
attcaagacaaaataacgagaa

SEQ ID NO: 1391568 - DNA, 22 bp, Artificial Sequence
  chemically synthesized
aattcaagacaaaataacgaga

SEQ ID NO: 1391569 - DNA, 22 bp, Artificial Sequence
  chemically synthesized
taattcaagacaaaataacgag

SEQ ID NO: 1391570 - DNA, 22 bp, Artificial Sequence
  chemically synthesized
ttaattcaagacaaaataacga

SEQ ID NO: 1391571 - DNA, 22 bp, Artificial Sequence
  chemically synthesized
tttaattcaagacaaaataacg

SEQ ID NO: 1391572 - DNA, 22 bp, Artificial Sequence
  chemically synthesized
atgttctcgttattttgtcttg

SEQ ID NO: 1391573 - DNA, 22 bp, Artificial Sequence
  chemically synthesized
tcgttattttgtcttgaattaa

SEQ ID NO: 1391574 - DNA, 22 bp, Artificial Sequence
  chemically synthesized
gttattttgtcttgaattaaaa

SEQ ID NO: 1391575 - DNA, 22 bp, Artificial Sequence
  chemically synthesized
taataaaaagactttttaattc

SEQ ID NO: 1391576 - DNA, 22 bp, Artificial Sequence
  chemically synthesized
ttttgtcttgaattaaaaagtc

SEQ ID NO: 1391577 - DNA, 22 bp, Artificial Sequence
  chemically synthesized
ttataataaaaagactttttaa

SEQ ID NO: 1391578 - DNA, 22 bp, Artificial Sequence
  chemically synthesized
tgtcttgaattaaaaagtcttt

SEQ ID NO: 1391579 - DNA, 22 bp, Artificial Sequence
  chemically synthesized
gtcttgaattaaaaagtctttt

SEQ ID NO: 1391580 - DNA, 22 bp, Artificial Sequence
  chemically synthesized
tcttgaattaaaaagtcttttt

SEQ ID NO: 1391581 - DNA, 22 bp, Artificial Sequence
  chemically synthesized
gaattaaaaagtctttttatta

SEQ ID NO: 1391582 - DNA, 22 bp, Artificial Sequence
  chemically synthesized
aattaaaaagtctttttattat

SEQ ID NO: 1391583 - DNA, 22 bp, Artificial Sequence
  chemically synthesized
aaaagtctttttattataataa

SEQ ID NO: 1391584 - DNA, 22 bp, Artificial Sequence
  chemically synthesized
cagtgaaataataattattata

SEQ ID NO: 1391585 - DNA, 22 bp, Artificial Sequence
  chemically synthesized
ccagtgaaataataattattat

SEQ ID NO: 1391586 - DNA, 22 bp, Artificial Sequence
  chemically synthesized
tccagtgaaataataattatta

SEQ ID NO: 1391587 - DNA, 22 bp, Artificial Sequence
  chemically synthesized
ttccagtgaaataataattatt

SEQ ID NO: 1391588 - DNA, 22 bp, Artificial Sequence
  chemically synthesized
tttccagtgaaataataattat

SEQ ID NO: 1391589 - DNA, 22 bp, Artificial Sequence
  chemically synthesized
tttattataataattattattt

SEQ ID NO: 1391590 - DNA, 22 bp, Artificial Sequence
  chemically synthesized
ttattataataattattatttc

SEQ ID NO: 1391591 - DNA, 22 bp, Artificial Sequence
  chemically synthesized
tattataataattattatttca

SEQ ID NO: 1391592 - DNA, 22 bp, Artificial Sequence
  chemically synthesized
attataataattattatttcac

SEQ ID NO: 1391593 - DNA, 22 bp, Artificial Sequence
  chemically synthesized
ttataataattattatttcact

SEQ ID NO: 1391594 - DNA, 22 bp, Artificial Sequence
  chemically synthesized
taataattattatttcactgga

SEQ ID NO: 1391595 - DNA, 22 bp, Artificial Sequence
  chemically synthesized
tatgtagctttttccagtgaaa

SEQ ID NO: 1391596 - DNA, 22 bp, Artificial Sequence
  chemically synthesized
atatgtagctttttccagtgaa

SEQ ID NO: 1391597 - DNA, 22 bp, Artificial Sequence
  chemically synthesized
tttatatgtagctttttccagt

SEQ ID NO: 1391598 - DNA, 22 bp, Artificial Sequence
  chemically synthesized
atttatatgtagctttttccag

SEQ ID NO: 1391599 - DNA, 22 bp, Artificial Sequence
  chemically synthesized
tatttatatgtagctttttcca

SEQ ID NO: 1391600 - DNA, 22 bp, Artificial Sequence
  chemically synthesized
ttatttatatgtagctttttcc

SEQ ID NO: 1391601 - DNA, 22 bp, Artificial Sequence
  chemically synthesized
tttatttatatgtagctttttc

SEQ ID NO: 1391602 - DNA, 22 bp, Artificial Sequence
  chemically synthesized
ttatttcactggaaaaagctac

SEQ ID NO: 1391603 - DNA, 22 bp, Artificial Sequence
  chemically synthesized
tttttatttatatgtagctttt

SEQ ID NO: 1391604 - DNA, 22 bp, Artificial Sequence
  chemically synthesized
tttcactggaaaaagctacata

SEQ ID NO: 1391605 - DNA, 22 bp, Artificial Sequence
  chemically synthesized
tctttttatttatatgtagctt

SEQ ID NO: 1391606 - DNA, 22 bp, Artificial Sequence
  chemically synthesized
ctctttttatttatatgtagct

SEQ ID NO: 1391607 - DNA, 22 bp, Artificial Sequence
  chemically synthesized
cactggaaaaagctacatataa

SEQ ID NO: 1391608 - DNA, 22 bp, Artificial Sequence
  chemically synthesized
actggaaaaagctacatataaa

SEQ ID NO: 1391609 - DNA, 22 bp, Artificial Sequence
  chemically synthesized
gaaaaagctacatataaataaa

SEQ ID NO: 1391610 - DNA, 22 bp, Artificial Sequence
  chemically synthesized
taagtatttctctttttattta

SEQ ID NO: 1391611 - DNA, 22 bp, Artificial Sequence
  chemically synthesized
catataaataaaaagagaaata

SEQ ID NO: 1391612 - DNA, 22 bp, Artificial Sequence
  chemically synthesized
gcaataaaattataagtatttc

SEQ ID NO: 1391613 - DNA, 22 bp, Artificial Sequence
  chemically synthesized
ggcaataaaattataagtattt

SEQ ID NO: 1391614 - DNA, 22 bp, Artificial Sequence
  chemically synthesized
ttggcaataaaattataagtat

SEQ ID NO: 1391615 - DNA, 22 bp, Artificial Sequence
  chemically synthesized
tctcttggcaataaaattataa

SEQ ID NO: 1391616 - DNA, 22 bp, Artificial Sequence
  chemically synthesized
ggtgtctatctcttggcaataa

SEQ ID NO: 1391617 - DNA, 22 bp, Artificial Sequence
  chemically synthesized
ataattttattgccaagagata

SEQ ID NO: 1391618 - DNA, 22 bp, Artificial Sequence
  chemically synthesized
taattttattgccaagagatag

SEQ ID NO: 1391619 - DNA, 22 bp, Artificial Sequence
  chemically synthesized
aaataaattgggtgtctatctc

SEQ ID NO: 1391620 - DNA, 22 bp, Artificial Sequence
  chemically synthesized
caaataaattgggtgtctatct

SEQ ID NO: 1391621 - DNA, 22 bp, Artificial Sequence
  chemically synthesized
tattgccaagagatagacaccc

SEQ ID NO: 1391622 - DNA, 22 bp, Artificial Sequence
  chemically synthesized
attgccaagagatagacaccca

SEQ ID NO: 1391623 - DNA, 22 bp, Artificial Sequence
  chemically synthesized
ttgccaagagatagacacccaa

SEQ ID NO: 1391624 - DNA, 22 bp, Artificial Sequence
  chemically synthesized
ccaagagatagacacccaattt

SEQ ID NO: 1391625 - DNA, 22 bp, Artificial Sequence
  chemically synthesized
gaaatagtcttcaaataaattg

SEQ ID NO: 1391626 - DNA, 22 bp, Artificial Sequence
  chemically synthesized
ggaaatagtcttcaaataaatt

SEQ ID NO: 1391627 - DNA, 22 bp, Artificial Sequence
  chemically synthesized
tcgtttggaaatagtcttcaaa

SEQ ID NO: 1391628 - DNA, 22 bp, Artificial Sequence
  chemically synthesized
atttgaagactatttccaaacg

SEQ ID NO: 1391629 - DNA, 22 bp, Artificial Sequence
  chemically synthesized
tttgaagactatttccaaacga

SEQ ID NO: 1391630 - DNA, 22 bp, Artificial Sequence
  chemically synthesized
gaagactatttccaaacgacag

SEQ ID NO: 1391631 - DNA, 22 bp, Artificial Sequence
  chemically synthesized
aagactatttccaaacgacagt

SEQ ID NO: 1391632 - DNA, 22 bp, Artificial Sequence
  chemically synthesized
tttccaaacgacagttttttct

SEQ ID NO: 1391633 - DNA, 22 bp, Artificial Sequence
  chemically synthesized
ccaaacgacagttttttctgtg

SEQ ID NO: 1391634 - DNA, 22 bp, Artificial Sequence
  chemically synthesized
caaacgacagttttttctgtgt

SEQ ID NO: 1391635 - DNA, 22 bp, Artificial Sequence
  chemically synthesized
tttctgtgtctccgtcttcatc

SEQ ID NO: 1391636 - DNA, 22 bp, Artificial Sequence
  chemically synthesized
ttctgtgtctccgtcttcatct

SEQ ID NO: 1391637 - DNA, 22 bp, Artificial Sequence
  chemically synthesized
tctgtgtctccgtcttcatctt

SEQ ID NO: 1391638 - DNA, 22 bp, Artificial Sequence
  chemically synthesized
ctgtgtctccgtcttcatcttt

SEQ ID NO: 1391639 - DNA, 22 bp, Artificial Sequence
  chemically synthesized
tgtgtctccgtcttcatctttc

SEQ ID NO: 1391640 - DNA, 22 bp, Artificial Sequence
  chemically synthesized
tgtctccgtcttcatctttccc

SEQ ID NO: 1391641 - DNA, 22 bp, Artificial Sequence
  chemically synthesized
cgtcttcatctttcccacattc

SEQ ID NO: 1391642 - DNA, 22 bp, Artificial Sequence
  chemically synthesized
catctttcccacattctgcttc

SEQ ID NO: 1391643 - DNA, 22 bp, Artificial Sequence
  chemically synthesized
atctttcccacattctgcttcg

SEQ ID NO: 1391644 - DNA, 22 bp, Artificial Sequence
  chemically synthesized
gggtaacatatatcgaagcaga

SEQ ID NO: 1391645 - DNA, 22 bp, Artificial Sequence
  chemically synthesized
agggtaacatatatcgaagcag

SEQ ID NO: 1391646 - DNA, 22 bp, Artificial Sequence
  chemically synthesized
tagggtaacatatatcgaagca

SEQ ID NO: 1391647 - DNA, 22 bp, Artificial Sequence
  chemically synthesized
ttagggtaacatatatcgaagc

SEQ ID NO: 1391648 - DNA, 22 bp, Artificial Sequence
  chemically synthesized
tcccacattctgcttcgatata

SEQ ID NO: 1391649 - DNA, 22 bp, Artificial Sequence
  chemically synthesized
cccacattctgcttcgatatat

SEQ ID NO: 1391650 - DNA, 22 bp, Artificial Sequence
  chemically synthesized
ccacattctgcttcgatatatg

SEQ ID NO: 1391651 - DNA, 22 bp, Artificial Sequence
  chemically synthesized
tgcttcgatatatgttacccta

SEQ ID NO: 1391652 - DNA, 22 bp, Artificial Sequence
  chemically synthesized
cttcgatatatgttaccctaaa

SEQ ID NO: 1391653 - DNA, 22 bp, Artificial Sequence
  chemically synthesized
cgatatatgttaccctaaaaat

SEQ ID NO: 1391654 - DNA, 22 bp, Artificial Sequence
  chemically synthesized
gatatatgttaccctaaaaatc

SEQ ID NO: 1391655 - DNA, 22 bp, Artificial Sequence
  chemically synthesized
caaaacaatatatgtagtagga

SEQ ID NO: 1391656 - DNA, 22 bp, Artificial Sequence
  chemically synthesized
ccctaaaaatcctactacatat

SEQ ID NO: 1391657 - DNA, 22 bp, Artificial Sequence
  chemically synthesized
aaaatcctactacatatattgt

SEQ ID NO: 1391658 - DNA, 22 bp, Artificial Sequence
  chemically synthesized
caagtgagttacaaaacaatat

SEQ ID NO: 1391659 - DNA, 22 bp, Artificial Sequence
  chemically synthesized
ctacatatattgttttgtaact

SEQ ID NO: 1391660 - DNA, 22 bp, Artificial Sequence
  chemically synthesized
catatattgttttgtaactcac

SEQ ID NO: 1391661 - DNA, 22 bp, Artificial Sequence
  chemically synthesized
aaaaatattacaagtgagttac

SEQ ID NO: 1391662 - DNA, 22 bp, Artificial Sequence
  chemically synthesized
ttgaaaaatattacaagtgagt

SEQ ID NO: 1391663 - DNA, 22 bp, Artificial Sequence
  chemically synthesized
ttttgtaactcacttgtaatat

SEQ ID NO: 1391664 - DNA, 22 bp, Artificial Sequence
  chemically synthesized
tgtaactcacttgtaatatttt

SEQ ID NO: 1391665 - DNA, 22 bp, Artificial Sequence
  chemically synthesized
gtaactcacttgtaatattttt

SEQ ID NO: 1391666 - DNA, 22 bp, Artificial Sequence
  chemically synthesized
taactcacttgtaatatttttc

SEQ ID NO: 1391667 - DNA, 22 bp, Artificial Sequence
  chemically synthesized
acttgtaatatttttcaatagt

SEQ ID NO: 1391668 - DNA, 22 bp, Artificial Sequence
  chemically synthesized
gtaatatttttcaatagtttct

SEQ ID NO: 1391669 - DNA, 22 bp, Artificial Sequence
  chemically synthesized
taatatttttcaatagtttctg

SEQ ID NO: 1391670 - DNA, 22 bp, Artificial Sequence
  chemically synthesized
ttcaatagtttctggccatgtt

SEQ ID NO: 1391671 - DNA, 22 bp, Artificial Sequence
  chemically synthesized
tcaatagtttctggccatgttt

SEQ ID NO: 1391672 - DNA, 22 bp, Artificial Sequence
  chemically synthesized
caatagtttctggccatgtttc

SEQ ID NO: 1391673 - DNA, 22 bp, Artificial Sequence
  chemically synthesized
aatagtttctggccatgtttct

SEQ ID NO: 1391674 - DNA, 22 bp, Artificial Sequence
  chemically synthesized
agtatataaaagtagaaacatg

SEQ ID NO: 1391675 - DNA, 22 bp, Artificial Sequence
  chemically synthesized
cagtatataaaagtagaaacat

SEQ ID NO: 1391676 - DNA, 22 bp, Artificial Sequence
  chemically synthesized
tttcagtatataaaagtagaaa

SEQ ID NO: 1391677 - DNA, 22 bp, Artificial Sequence
  chemically synthesized
ctggccatgtttctacttttat

SEQ ID NO: 1391678 - DNA, 22 bp, Artificial Sequence
  chemically synthesized
tggccatgtttctacttttata

SEQ ID NO: 1391679 - DNA, 22 bp, Artificial Sequence
  chemically synthesized
aattgtttcagtatataaaagt

SEQ ID NO: 1391680 - DNA, 22 bp, Artificial Sequence
  chemically synthesized
gccatgtttctacttttatata

SEQ ID NO: 1391681 - DNA, 22 bp, Artificial Sequence
  chemically synthesized
ttgaattgtttcagtatataaa

SEQ ID NO: 1391682 - DNA, 22 bp, Artificial Sequence
  chemically synthesized
ctacttttatatactgaaacaa

SEQ ID NO: 1391683 - DNA, 22 bp, Artificial Sequence
  chemically synthesized
tacttttatatactgaaacaat

SEQ ID NO: 1391684 - DNA, 22 bp, Artificial Sequence
  chemically synthesized
cttttatatactgaaacaattc

SEQ ID NO: 1391685 - DNA, 22 bp, Artificial Sequence
  chemically synthesized
ttatatactgaaacaattcaat

SEQ ID NO: 1391686 - DNA, 22 bp, Artificial Sequence
  chemically synthesized
tatatactgaaacaattcaata

SEQ ID NO: 1391687 - DNA, 22 bp, Artificial Sequence
  chemically synthesized
atatactgaaacaattcaataa

SEQ ID NO: 1391688 - DNA, 22 bp, Artificial Sequence
  chemically synthesized
tatactgaaacaattcaataat

SEQ ID NO: 1391689 - DNA, 22 bp, Artificial Sequence
  chemically synthesized
tgcagccatcaaattattgaat

SEQ ID NO: 1391690 - DNA, 22 bp, Artificial Sequence
  chemically synthesized
aaacaattcaataatttgatgg

SEQ ID NO: 1391691 - DNA, 22 bp, Artificial Sequence
  chemically synthesized
taaaatagcaaattatgcagcc

SEQ ID NO: 1391692 - DNA, 22 bp, Artificial Sequence
  chemically synthesized
aataatttgatggctgcataat

SEQ ID NO: 1391693 - DNA, 22 bp, Artificial Sequence
  chemically synthesized
ataaaatagcaaattatgcagc

SEQ ID NO: 1391694 - DNA, 22 bp, Artificial Sequence
  chemically synthesized
gatggctgcataatttgctatt

SEQ ID NO: 1391695 - DNA, 22 bp, Artificial Sequence
  chemically synthesized
atggctgcataatttgctattt

SEQ ID NO: 1391696 - DNA, 22 bp, Artificial Sequence
  chemically synthesized
tataagatttataaaatagcaa

SEQ ID NO: 1391697 - DNA, 22 bp, Artificial Sequence
  chemically synthesized
cataatttgctattttataaat

SEQ ID NO: 1391698 - DNA, 22 bp, Artificial Sequence
  chemically synthesized
gctattttataaatcttatata

SEQ ID NO: 1391699 - DNA, 22 bp, Artificial Sequence
  chemically synthesized
ctattttataaatcttatataa

SEQ ID NO: 1391700 - DNA, 22 bp, Artificial Sequence
  chemically synthesized
ttttataaatcttatataattt

SEQ ID NO: 1391701 - DNA, 22 bp, Artificial Sequence
  chemically synthesized
tataaatcttatataatttatt

SEQ ID NO: 1391702 - DNA, 22 bp, Artificial Sequence
  chemically synthesized
ataaatcttatataatttattt

SEQ ID NO: 1391703 - DNA, 22 bp, Artificial Sequence
  chemically synthesized
taaatcttatataatttatttg

SEQ ID NO: 1391704 - DNA, 22 bp, Artificial Sequence
  chemically synthesized
atacaagtgtggtcaaataaat

SEQ ID NO: 1391705 - DNA, 22 bp, Artificial Sequence
  chemically synthesized
cctaatacaagtgtggtcaaat

SEQ ID NO: 1391706 - DNA, 22 bp, Artificial Sequence
  chemically synthesized
atataatttatttgaccacact

SEQ ID NO: 1391707 - DNA, 22 bp, Artificial Sequence
  chemically synthesized
ttccctaatacaagtgtggtca

SEQ ID NO: 1391708 - DNA, 22 bp, Artificial Sequence
  chemically synthesized
tataatttatttgaccacactt

SEQ ID NO: 1391709 - DNA, 22 bp, Artificial Sequence
  chemically synthesized
attccctaatacaagtgtggtc

SEQ ID NO: 1391710 - DNA, 22 bp, Artificial Sequence
  chemically synthesized
catcttattccctaatacaagt

SEQ ID NO: 1391711 - DNA, 22 bp, Artificial Sequence
  chemically synthesized
atttgaccacacttgtattagg

SEQ ID NO: 1391712 - DNA, 22 bp, Artificial Sequence
  chemically synthesized
tttgaccacacttgtattaggg

SEQ ID NO: 1391713 - DNA, 22 bp, Artificial Sequence
  chemically synthesized
gaccacacttgtattagggaat

SEQ ID NO: 1391714 - DNA, 22 bp, Artificial Sequence
  chemically synthesized
accacacttgtattagggaata

SEQ ID NO: 1391715 - DNA, 22 bp, Artificial Sequence
  chemically synthesized
gtattagggaataagatgtaac

SEQ ID NO: 1391716 - DNA, 22 bp, Artificial Sequence
  chemically synthesized
tattagggaataagatgtaacc

SEQ ID NO: 1391717 - DNA, 22 bp, Artificial Sequence
  chemically synthesized
catgaatatacaaatgggttac

SEQ ID NO: 1391718 - DNA, 22 bp, Artificial Sequence
  chemically synthesized
gggaataagatgtaacccattt

SEQ ID NO: 1391719 - DNA, 22 bp, Artificial Sequence
  chemically synthesized
gcatgaatatacaaatgggtta

SEQ ID NO: 1391720 - DNA, 22 bp, Artificial Sequence
  chemically synthesized
gcatatataatttgcatgaata

SEQ ID NO: 1391721 - DNA, 22 bp, Artificial Sequence
  chemically synthesized
aaattggcatatataatttgca

SEQ ID NO: 1391722 - DNA, 22 bp, Artificial Sequence
  chemically synthesized
gtatattcatgcaaattatata

SEQ ID NO: 1391723 - DNA, 22 bp, Artificial Sequence
  chemically synthesized
tatattcatgcaaattatatat

SEQ ID NO: 1391724 - DNA, 22 bp, Artificial Sequence
  chemically synthesized
aatgttaaaattggcatatata

SEQ ID NO: 1391725 - DNA, 22 bp, Artificial Sequence
  chemically synthesized
atgcaaattatatatgccaatt

SEQ ID NO: 1391726 - DNA, 22 bp, Artificial Sequence
  chemically synthesized
tatatgccaattttaacattta

SEQ ID NO: 1391727 - DNA, 22 bp, Artificial Sequence
  chemically synthesized
agataatgtggacaatgtgtat

SEQ ID NO: 1391728 - DNA, 22 bp, Artificial Sequence
  chemically synthesized
gagataatgtggacaatgtgta

SEQ ID NO: 1391729 - DNA, 22 bp, Artificial Sequence
  chemically synthesized
taacatttaatacacattgtcc

SEQ ID NO: 1391730 - DNA, 22 bp, Artificial Sequence
  chemically synthesized
aacatttaatacacattgtcca

SEQ ID NO: 1391731 - DNA, 22 bp, Artificial Sequence
  chemically synthesized
cttgagataatgtggacaatgt

SEQ ID NO: 1391732 - DNA, 22 bp, Artificial Sequence
  chemically synthesized
acatttaatacacattgtccac

SEQ ID NO: 1391733 - DNA, 22 bp, Artificial Sequence
  chemically synthesized
gcttgagataatgtggacaatg

SEQ ID NO: 1391734 - DNA, 22 bp, Artificial Sequence
  chemically synthesized
aatacacattgtccacattatc

SEQ ID NO: 1391735 - DNA, 22 bp, Artificial Sequence
  chemically synthesized
atacacattgtccacattatct

SEQ ID NO: 1391736 - DNA, 22 bp, Artificial Sequence
  chemically synthesized
taaatttgcttgagataatgtg

SEQ ID NO: 1391737 - DNA, 22 bp, Artificial Sequence
  chemically synthesized
ataaatttgcttgagataatgt

SEQ ID NO: 1391738 - DNA, 22 bp, Artificial Sequence
  chemically synthesized
ttataaatttgcttgagataat

SEQ ID NO: 1391739 - DNA, 22 bp, Artificial Sequence
  chemically synthesized
tccacattatctcaagcaaatt

SEQ ID NO: 1391740 - DNA, 22 bp, Artificial Sequence
  chemically synthesized
tctcaagcaaatttataagaat

SEQ ID NO: 1391741 - DNA, 22 bp, Artificial Sequence
  chemically synthesized
aagcaaatttataagaatgtat

SEQ ID NO: 1391742 - DNA, 22 bp, Artificial Sequence
  chemically synthesized
gtagtggaatacatacattctt

SEQ ID NO: 1391743 - DNA, 22 bp, Artificial Sequence
  chemically synthesized
ataagaatgtatgtattccact

SEQ ID NO: 1391744 - DNA, 22 bp, Artificial Sequence
  chemically synthesized
tgcagtattagtagtggaatac

SEQ ID NO: 1391745 - DNA, 22 bp, Artificial Sequence
  chemically synthesized
taagaatgtatgtattccacta

SEQ ID NO: 1391746 - DNA, 22 bp, Artificial Sequence
  chemically synthesized
gtgcagtattagtagtggaata

SEQ ID NO: 1391747 - DNA, 22 bp, Artificial Sequence
  chemically synthesized
cactactaatactgcacaagac

SEQ ID NO: 1391748 - DNA, 22 bp, Artificial Sequence
  chemically synthesized
atgaaaatagaaagtcttgtgc

SEQ ID NO: 1391749 - DNA, 22 bp, Artificial Sequence
  chemically synthesized
ctaatactgcacaagactttct

SEQ ID NO: 1391750 - DNA, 22 bp, Artificial Sequence
  chemically synthesized
agattgatgaaaatagaaagtc

SEQ ID NO: 1391751 - DNA, 22 bp, Artificial Sequence
  chemically synthesized
atactgcacaagactttctatt

SEQ ID NO: 1391752 - DNA, 22 bp, Artificial Sequence
  chemically synthesized
ctaagattgatgaaaatagaaa

SEQ ID NO: 1391753 - DNA, 22 bp, Artificial Sequence
  chemically synthesized
ctcctaagattgatgaaaatag

SEQ ID NO: 1391754 - DNA, 22 bp, Artificial Sequence
  chemically synthesized
cacaagactttctattttcatc

SEQ ID NO: 1391755 - DNA, 22 bp, Artificial Sequence
  chemically synthesized
tctattttcatcaatcttagga

SEQ ID NO: 1391756 - DNA, 22 bp, Artificial Sequence
  chemically synthesized
ctattttcatcaatcttaggag

SEQ ID NO: 1391757 - DNA, 22 bp, Artificial Sequence
  chemically synthesized
tattttcatcaatcttaggagt

SEQ ID NO: 1391758 - DNA, 22 bp, Artificial Sequence
  chemically synthesized
ttttcatcaatcttaggagtaa

SEQ ID NO: 1391759 - DNA, 22 bp, Artificial Sequence
  chemically synthesized
tcatcaatcttaggagtaatta

SEQ ID NO: 1391760 - DNA, 22 bp, Artificial Sequence
  chemically synthesized
catcaatcttaggagtaattac

SEQ ID NO: 1391761 - DNA, 22 bp, Artificial Sequence
  chemically synthesized
atcaatcttaggagtaattacc

SEQ ID NO: 1391762 - DNA, 22 bp, Artificial Sequence
  chemically synthesized
aggagtaattaccacggtgggt

SEQ ID NO: 1391763 - DNA, 22 bp, Artificial Sequence
  chemically synthesized
ggagtaattaccacggtgggtt

SEQ ID NO: 1391764 - DNA, 22 bp, Artificial Sequence
  chemically synthesized
gggaagggaatgaaaacaaacc

SEQ ID NO: 1391765 - DNA, 22 bp, Artificial Sequence
  chemically synthesized
ggggaagggaatgaaaacaaac

SEQ ID NO: 1391766 - DNA, 22 bp, Artificial Sequence
  chemically synthesized
tggggaagggaatgaaaacaaa

SEQ ID NO: 1391767 - DNA, 22 bp, Artificial Sequence
  chemically synthesized
ccacggtgggtttgttttcatt

SEQ ID NO: 1391768 - DNA, 22 bp, Artificial Sequence
  chemically synthesized
cggaagttttggggaagggaat

SEQ ID NO: 1391769 - DNA, 22 bp, Artificial Sequence
  chemically synthesized
ttacggaagttttggggaaggg

SEQ ID NO: 1391770 - DNA, 22 bp, Artificial Sequence
  chemically synthesized
gttttcattcccttccccaaaa

SEQ ID NO: 1391771 - DNA, 22 bp, Artificial Sequence
  chemically synthesized
ttttcattcccttccccaaaac

SEQ ID NO: 1391772 - DNA, 22 bp, Artificial Sequence
  chemically synthesized
tcattcccttccccaaaacttc

SEQ ID NO: 1391773 - DNA, 22 bp, Artificial Sequence
  chemically synthesized
cattcccttccccaaaacttcc

SEQ ID NO: 1391774 - DNA, 22 bp, Artificial Sequence
  chemically synthesized
attcccttccccaaaacttccg

SEQ ID NO: 1391775 - DNA, 22 bp, Artificial Sequence
  chemically synthesized
ccttccccaaaacttccgtaac

SEQ ID NO: 1391776 - DNA, 22 bp, Artificial Sequence
  chemically synthesized
ccccaaaacttccgtaacaatc

SEQ ID NO: 1391777 - DNA, 22 bp, Artificial Sequence
  chemically synthesized
cccaaaacttccgtaacaatct

SEQ ID NO: 1391778 - DNA, 22 bp, Artificial Sequence
  chemically synthesized
ccgtaacaatctttggggtttt

SEQ ID NO: 1391779 - DNA, 22 bp, Artificial Sequence
  chemically synthesized
cgtaacaatctttggggttttg

SEQ ID NO: 1391780 - DNA, 22 bp, Artificial Sequence
  chemically synthesized
tggggttttgtcacatctccct

SEQ ID NO: 1391781 - DNA, 22 bp, Artificial Sequence
  chemically synthesized
ggggttttgtcacatctccctt

SEQ ID NO: 1391782 - DNA, 22 bp, Artificial Sequence
  chemically synthesized
gggttttgtcacatctcccttc

SEQ ID NO: 1391783 - DNA, 22 bp, Artificial Sequence
  chemically synthesized
aaggtgatgtaggtgtgaaggg

SEQ ID NO: 1391784 - DNA, 22 bp, Artificial Sequence
  chemically synthesized
aaaggtgatgtaggtgtgaagg

SEQ ID NO: 1391785 - DNA, 22 bp, Artificial Sequence
  chemically synthesized
tgtcacatctcccttcacacct

SEQ ID NO: 1391786 - DNA, 22 bp, Artificial Sequence
  chemically synthesized
taaaggtgatgtaggtgtgaag

SEQ ID NO: 1391787 - DNA, 22 bp, Artificial Sequence
  chemically synthesized
gtcacatctcccttcacaccta

SEQ ID NO: 1391788 - DNA, 22 bp, Artificial Sequence
  chemically synthesized
tcacatctcccttcacacctac

SEQ ID NO: 1391789 - DNA, 22 bp, Artificial Sequence
  chemically synthesized
gttttaaaggtgatgtaggtgt

SEQ ID NO: 1391790 - DNA, 22 bp, Artificial Sequence
  chemically synthesized
ggttttaaaggtgatgtaggtg

SEQ ID NO: 1391791 - DNA, 22 bp, Artificial Sequence
  chemically synthesized
ttggttttaaaggtgatgtagg

SEQ ID NO: 1391792 - DNA, 22 bp, Artificial Sequence
  chemically synthesized
ccttcacacctacatcaccttt

SEQ ID NO: 1391793 - DNA, 22 bp, Artificial Sequence
  chemically synthesized
actcttggttttaaaggtgatg

SEQ ID NO: 1391794 - DNA, 22 bp, Artificial Sequence
  chemically synthesized
cacacctacatcacctttaaaa

SEQ ID NO: 1391795 - DNA, 22 bp, Artificial Sequence
  chemically synthesized
acacctacatcacctttaaaac

SEQ ID NO: 1391796 - DNA, 22 bp, Artificial Sequence
  chemically synthesized
catcacctttaaaaccaagagt

SEQ ID NO: 1391797 - DNA, 22 bp, Artificial Sequence
  chemically synthesized
caaaatgagtcctaactcttgg

SEQ ID NO: 1391798 - DNA, 22 bp, Artificial Sequence
  chemically synthesized
taaaaccaagagttaggactca

SEQ ID NO: 1391799 - DNA, 22 bp, Artificial Sequence
  chemically synthesized
aaaaccaagagttaggactcat

SEQ ID NO: 1391800 - DNA, 22 bp, Artificial Sequence
  chemically synthesized
aaaccaagagttaggactcatt

SEQ ID NO: 1391801 - DNA, 22 bp, Artificial Sequence
  chemically synthesized
tataaaaaaatgattccaaaat

SEQ ID NO: 1391802 - DNA, 22 bp, Artificial Sequence
  chemically synthesized
agctgtataaaaaaatgattcc

SEQ ID NO: 1391803 - DNA, 22 bp, Artificial Sequence
  chemically synthesized
ggactcattttggaatcatttt

SEQ ID NO: 1391804 - DNA, 22 bp, Artificial Sequence
  chemically synthesized
gagctgtataaaaaaatgattc

SEQ ID NO: 1391805 - DNA, 22 bp, Artificial Sequence
  chemically synthesized
tgagctgtataaaaaaatgatt

SEQ ID NO: 1391806 - DNA, 22 bp, Artificial Sequence
  chemically synthesized
actttgagctgtataaaaaaat

SEQ ID NO: 1391807 - DNA, 22 bp, Artificial Sequence
  chemically synthesized
attttggaatcatttttttata

SEQ ID NO: 1391808 - DNA, 22 bp, Artificial Sequence
  chemically synthesized
tggaatcatttttttatacagc

SEQ ID NO: 1391809 - DNA, 22 bp, Artificial Sequence
  chemically synthesized
ggaatcatttttttatacagct

SEQ ID NO: 1391810 - DNA, 22 bp, Artificial Sequence
  chemically synthesized
gaatcatttttttatacagctc

SEQ ID NO: 1391811 - DNA, 22 bp, Artificial Sequence
  chemically synthesized
aatataatgtaactgactttga

SEQ ID NO: 1391812 - DNA, 22 bp, Artificial Sequence
  chemically synthesized
ttttatacagctcaaagtcagt

SEQ ID NO: 1391813 - DNA, 22 bp, Artificial Sequence
  chemically synthesized
tttatacagctcaaagtcagtt

SEQ ID NO: 1391814 - DNA, 22 bp, Artificial Sequence
  chemically synthesized
ttatacagctcaaagtcagtta

SEQ ID NO: 1391815 - DNA, 22 bp, Artificial Sequence
  chemically synthesized
tatacagctcaaagtcagttac

SEQ ID NO: 1391816 - DNA, 22 bp, Artificial Sequence
  chemically synthesized
atacagctcaaagtcagttaca

SEQ ID NO: 1391817 - DNA, 22 bp, Artificial Sequence
  chemically synthesized
tacagctcaaagtcagttacat

SEQ ID NO: 1391818 - DNA, 22 bp, Artificial Sequence
  chemically synthesized
atggtactaaatataatgtaac

SEQ ID NO: 1391819 - DNA, 22 bp, Artificial Sequence
  chemically synthesized
taatggtactaaatataatgta

SEQ ID NO: 1391820 - DNA, 22 bp, Artificial Sequence
  chemically synthesized
ctaatggtactaaatataatgt

SEQ ID NO: 1391821 - DNA, 22 bp, Artificial Sequence
  chemically synthesized
aaagtcagttacattatattta

SEQ ID NO: 1391822 - DNA, 22 bp, Artificial Sequence
  chemically synthesized
tatcttctaatggtactaaata

SEQ ID NO: 1391823 - DNA, 22 bp, Artificial Sequence
  chemically synthesized
gtatcttctaatggtactaaat

SEQ ID NO: 1391824 - DNA, 22 bp, Artificial Sequence
  chemically synthesized
cattatatttagtaccattaga

SEQ ID NO: 1391825 - DNA, 22 bp, Artificial Sequence
  chemically synthesized
aggaaaatttgtatcttctaat

SEQ ID NO: 1391826 - DNA, 22 bp, Artificial Sequence
  chemically synthesized
tatttagtaccattagaagata

SEQ ID NO: 1391827 - DNA, 22 bp, Artificial Sequence
  chemically synthesized
agtaccattagaagatacaaat

SEQ ID NO: 1391828 - DNA, 22 bp, Artificial Sequence
  chemically synthesized
gtaccattagaagatacaaatt

SEQ ID NO: 1391829 - DNA, 22 bp, Artificial Sequence
  chemically synthesized
gaagatacaaattttcctcaac

SEQ ID NO: 1391830 - DNA, 22 bp, Artificial Sequence
  chemically synthesized
caacacccagaaagtgttgagg

SEQ ID NO: 1391831 - DNA, 22 bp, Artificial Sequence
  chemically synthesized
aggttccaacacccagaaagtg

SEQ ID NO: 1391832 - DNA, 22 bp, Artificial Sequence
  chemically synthesized
gaggttccaacacccagaaagt

SEQ ID NO: 1391833 - DNA, 22 bp, Artificial Sequence
  chemically synthesized
tgaggttccaacacccagaaag

SEQ ID NO: 1391834 - DNA, 22 bp, Artificial Sequence
  chemically synthesized
tcctcaacactttctgggtgtt

SEQ ID NO: 1391835 - DNA, 22 bp, Artificial Sequence
  chemically synthesized
cctcaacactttctgggtgttg

SEQ ID NO: 1391836 - DNA, 22 bp, Artificial Sequence
  chemically synthesized
ctcaacactttctgggtgttgg

SEQ ID NO: 1391837 - DNA, 22 bp, Artificial Sequence
  chemically synthesized
aacactttctgggtgttggaac

SEQ ID NO: 1391838 - DNA, 22 bp, Artificial Sequence
  chemically synthesized
aaatagttttgaggttccaaca

SEQ ID NO: 1391839 - DNA, 22 bp, Artificial Sequence
  chemically synthesized
aaaatagttttgaggttccaac

SEQ ID NO: 1391840 - DNA, 22 bp, Artificial Sequence
  chemically synthesized
taaaatagttttgaggttccaa

SEQ ID NO: 1391841 - DNA, 22 bp, Artificial Sequence
  chemically synthesized
ttaaaatagttttgaggttcca

SEQ ID NO: 1391842 - DNA, 22 bp, Artificial Sequence
  chemically synthesized
ttttaaaatagttttgaggttc

SEQ ID NO: 1391843 - DNA, 22 bp, Artificial Sequence
  chemically synthesized
tctgggtgttggaacctcaaaa

SEQ ID NO: 1391844 - DNA, 22 bp, Artificial Sequence
  chemically synthesized
ctgggtgttggaacctcaaaac

SEQ ID NO: 1391845 - DNA, 22 bp, Artificial Sequence
  chemically synthesized
tgggtgttggaacctcaaaact

SEQ ID NO: 1391846 - DNA, 22 bp, Artificial Sequence
  chemically synthesized
ctcttttaaaatagttttgagg

SEQ ID NO: 1391847 - DNA, 22 bp, Artificial Sequence
  chemically synthesized
ggtgttggaacctcaaaactat

SEQ ID NO: 1391848 - DNA, 22 bp, Artificial Sequence
  chemically synthesized
gctactcttttaaaatagtttt

SEQ ID NO: 1391849 - DNA, 22 bp, Artificial Sequence
  chemically synthesized
cgctactcttttaaaatagttt

SEQ ID NO: 1391850 - DNA, 22 bp, Artificial Sequence
  chemically synthesized
gaacctcaaaactattttaaaa

SEQ ID NO: 1391851 - DNA, 22 bp, Artificial Sequence
  chemically synthesized
tcttcgctactcttttaaaata

SEQ ID NO: 1391852 - DNA, 22 bp, Artificial Sequence
  chemically synthesized
aaaactattttaaaagagtagc

SEQ ID NO: 1391853 - DNA, 22 bp, Artificial Sequence
  chemically synthesized
aacatagatattatcttcgcta

SEQ ID NO: 1391854 - DNA, 22 bp, Artificial Sequence
  chemically synthesized
ttttaaaagagtagcgaagata

SEQ ID NO: 1391855 - DNA, 22 bp, Artificial Sequence
  chemically synthesized
caacatagatattatcttcgct

SEQ ID NO: 1391856 - DNA, 22 bp, Artificial Sequence
  chemically synthesized
taaaagagtagcgaagataata

SEQ ID NO: 1391857 - DNA, 22 bp, Artificial Sequence
  chemically synthesized
aaaagagtagcgaagataatat

SEQ ID NO: 1391858 - DNA, 22 bp, Artificial Sequence
  chemically synthesized
atttcaacatagatattatctt

SEQ ID NO: 1391859 - DNA, 22 bp, Artificial Sequence
  chemically synthesized
aaagagtagcgaagataatatc

SEQ ID NO: 1391860 - DNA, 22 bp, Artificial Sequence
  chemically synthesized
ttcatttcaacatagatattat

SEQ ID NO: 1391861 - DNA, 22 bp, Artificial Sequence
  chemically synthesized
attcatttcaacatagatatta

SEQ ID NO: 1391862 - DNA, 22 bp, Artificial Sequence
  chemically synthesized
tattcatttcaacatagatatt

SEQ ID NO: 1391863 - DNA, 22 bp, Artificial Sequence
  chemically synthesized
ttttattcatttcaacatagat

SEQ ID NO: 1391864 - DNA, 22 bp, Artificial Sequence
  chemically synthesized
atgatagatctattttattcat

SEQ ID NO: 1391865 - DNA, 22 bp, Artificial Sequence
  chemically synthesized
tgttgaaatgaataaaatagat

SEQ ID NO: 1391866 - DNA, 22 bp, Artificial Sequence
  chemically synthesized
aaatgaataaaatagatctatc

SEQ ID NO: 1391867 - DNA, 22 bp, Artificial Sequence
  chemically synthesized
taaaacatgatattcatgatag

SEQ ID NO: 1391868 - DNA, 22 bp, Artificial Sequence
  chemically synthesized
ataaaacatgatattcatgata

SEQ ID NO: 1391869 - DNA, 22 bp, Artificial Sequence
  chemically synthesized
tataaaacatgatattcatgat

SEQ ID NO: 1391870 - DNA, 22 bp, Artificial Sequence
  chemically synthesized
ttttataaaacatgatattcat

SEQ ID NO: 1391871 - DNA, 22 bp, Artificial Sequence
  chemically synthesized
tgttttataaaacatgatattc

SEQ ID NO: 1391872 - DNA, 22 bp, Artificial Sequence
  chemically synthesized
ctgttttataaaacatgatatt

SEQ ID NO: 1391873 - DNA, 22 bp, Artificial Sequence
  chemically synthesized
tcatgaatatcatgttttataa

SEQ ID NO: 1391874 - DNA, 22 bp, Artificial Sequence
  chemically synthesized
atacatttctgttttataaaac

SEQ ID NO: 1391875 - DNA, 22 bp, Artificial Sequence
  chemically synthesized
attgatacatttctgttttata

SEQ ID NO: 1391876 - DNA, 22 bp, Artificial Sequence
  chemically synthesized
cattgatacatttctgttttat

SEQ ID NO: 1391877 - DNA, 22 bp, Artificial Sequence
  chemically synthesized
tcattgatacatttctgtttta

SEQ ID NO: 1391878 - DNA, 22 bp, Artificial Sequence
  chemically synthesized
tgatctttcattgatacatttc

SEQ ID NO: 1391879 - DNA, 22 bp, Artificial Sequence
  chemically synthesized
atgatctttcattgatacattt

SEQ ID NO: 1391880 - DNA, 22 bp, Artificial Sequence
  chemically synthesized
tataaaacagaaatgtatcaat

SEQ ID NO: 1391881 - DNA, 22 bp, Artificial Sequence
  chemically synthesized
ataaaacagaaatgtatcaatg

SEQ ID NO: 1391882 - DNA, 22 bp, Artificial Sequence
  chemically synthesized
taaaacagaaatgtatcaatga

SEQ ID NO: 1391883 - DNA, 22 bp, Artificial Sequence
  chemically synthesized
acttatgatctttcattgatac

SEQ ID NO: 1391884 - DNA, 22 bp, Artificial Sequence
  chemically synthesized
aagtgttaacttatgatctttc

SEQ ID NO: 1391885 - DNA, 22 bp, Artificial Sequence
  chemically synthesized
aaagtgttaacttatgatcttt

SEQ ID NO: 1391886 - DNA, 22 bp, Artificial Sequence
  chemically synthesized
taaagtgttaacttatgatctt

SEQ ID NO: 1391887 - DNA, 22 bp, Artificial Sequence
  chemically synthesized
taaataacatatattttaaagt

SEQ ID NO: 1391888 - DNA, 22 bp, Artificial Sequence
  chemically synthesized
ataaataacatatattttaaag

SEQ ID NO: 1391889 - DNA, 22 bp, Artificial Sequence
  chemically synthesized
tttataaataacatatatttta

SEQ ID NO: 1391890 - DNA, 22 bp, Artificial Sequence
  chemically synthesized
acactttaaaatatatgttatt

SEQ ID NO: 1391891 - DNA, 22 bp, Artificial Sequence
  chemically synthesized
taaaatatatgttatttataaa

SEQ ID NO: 1391892 - DNA, 22 bp, Artificial Sequence
  chemically synthesized
aaaatatatgttatttataaac

SEQ ID NO: 1391893 - DNA, 22 bp, Artificial Sequence
  chemically synthesized
aaatatatgttatttataaaca

SEQ ID NO: 1391894 - DNA, 22 bp, Artificial Sequence
  chemically synthesized
cgaatatgtatatctgtttata

SEQ ID NO: 1391895 - DNA, 22 bp, Artificial Sequence
  chemically synthesized
ccgaatatgtatatctgtttat

SEQ ID NO: 1391896 - DNA, 22 bp, Artificial Sequence
  chemically synthesized
aagatcttccgaatatgtatat

SEQ ID NO: 1391897 - DNA, 22 bp, Artificial Sequence
  chemically synthesized
tttataaacagatatacatatt

SEQ ID NO: 1391898 - DNA, 22 bp, Artificial Sequence
  chemically synthesized
gaagatcttccgaatatgtata

SEQ ID NO: 1391899 - DNA, 22 bp, Artificial Sequence
  chemically synthesized
tgaagatcttccgaatatgtat

SEQ ID NO: 1391900 - DNA, 22 bp, Artificial Sequence
  chemically synthesized
ataaacagatatacatattcgg

SEQ ID NO: 1391901 - DNA, 22 bp, Artificial Sequence
  chemically synthesized
taaacagatatacatattcgga

SEQ ID NO: 1391902 - DNA, 22 bp, Artificial Sequence
  chemically synthesized
ctttgaagatcttccgaatatg

SEQ ID NO: 1391903 - DNA, 22 bp, Artificial Sequence
  chemically synthesized
ggaagatcttcaaagtagtaca

SEQ ID NO: 1391904 - DNA, 22 bp, Artificial Sequence
  chemically synthesized
gataagaatcaatgtactactt

SEQ ID NO: 1391905 - DNA, 22 bp, Artificial Sequence
  chemically synthesized
ggataagaatcaatgtactact

SEQ ID NO: 1391906 - DNA, 22 bp, Artificial Sequence
  chemically synthesized
caaagtagtacattgattctta

SEQ ID NO: 1391907 - DNA, 22 bp, Artificial Sequence
  chemically synthesized
aaagtagtacattgattcttat

SEQ ID NO: 1391908 - DNA, 22 bp, Artificial Sequence
  chemically synthesized
aaatcaaatttggataagaatc

SEQ ID NO: 1391909 - DNA, 22 bp, Artificial Sequence
  chemically synthesized
tcaaatcaaatttggataagaa

SEQ ID NO: 1391910 - DNA, 22 bp, Artificial Sequence
  chemically synthesized
attcttatccaaatttgatttg

SEQ ID NO: 1391911 - DNA, 22 bp, Artificial Sequence
  chemically synthesized
aaaccagtagctctcaaatcaa

SEQ ID NO: 1391912 - DNA, 22 bp, Artificial Sequence
  chemically synthesized
aaaaccagtagctctcaaatca

SEQ ID NO: 1391913 - DNA, 22 bp, Artificial Sequence
  chemically synthesized
ttatccaaatttgatttgagag

SEQ ID NO: 1391914 - DNA, 22 bp, Artificial Sequence
  chemically synthesized
atccaaatttgatttgagagct

SEQ ID NO: 1391915 - DNA, 22 bp, Artificial Sequence
  chemically synthesized
tccaaatttgatttgagagcta

SEQ ID NO: 1391916 - DNA, 22 bp, Artificial Sequence
  chemically synthesized
caaatttaaaaccagtagctct

SEQ ID NO: 1391917 - DNA, 22 bp, Artificial Sequence
  chemically synthesized
tattacaaatttaaaaccagta

SEQ ID NO: 1391918 - DNA, 22 bp, Artificial Sequence
  chemically synthesized
gatttgagagctactggtttta

SEQ ID NO: 1391919 - DNA, 22 bp, Artificial Sequence
  chemically synthesized
gtattacaaatttaaaaccagt

SEQ ID NO: 1391920 - DNA, 22 bp, Artificial Sequence
  chemically synthesized
atttgagagctactggttttaa

SEQ ID NO: 1391921 - DNA, 22 bp, Artificial Sequence
  chemically synthesized
gagagctactggttttaaattt

SEQ ID NO: 1391922 - DNA, 22 bp, Artificial Sequence
  chemically synthesized
agagctactggttttaaatttg

SEQ ID NO: 1391923 - DNA, 22 bp, Artificial Sequence
  chemically synthesized
ctggttttaaatttgtaataca

SEQ ID NO: 1391924 - DNA, 22 bp, Artificial Sequence
  chemically synthesized
gttttaaatttgtaatacaaat

SEQ ID NO: 1391925 - DNA, 22 bp, Artificial Sequence
  chemically synthesized
taaatttgtaatacaaattacg

SEQ ID NO: 1391926 - DNA, 22 bp, Artificial Sequence
  chemically synthesized
aaatttgtaatacaaattacga

SEQ ID NO: 1391927 - DNA, 22 bp, Artificial Sequence
  chemically synthesized
aatttgtaatacaaattacgat

SEQ ID NO: 1391928 - DNA, 22 bp, Artificial Sequence
  chemically synthesized
ggaaatccgcaccccatcgtaa

SEQ ID NO: 1391929 - DNA, 22 bp, Artificial Sequence
  chemically synthesized
gtaatacaaattacgatggggt

SEQ ID NO: 1391930 - DNA, 22 bp, Artificial Sequence
  chemically synthesized
taatacaaattacgatggggtg

SEQ ID NO: 1391931 - DNA, 22 bp, Artificial Sequence
  chemically synthesized
gcctaggaaatccgcaccccat

SEQ ID NO: 1391932 - DNA, 22 bp, Artificial Sequence
  chemically synthesized
cgatggggtgcggatttcctag

SEQ ID NO: 1391933 - DNA, 22 bp, Artificial Sequence
  chemically synthesized
tacataaaaaactggcctagga

SEQ ID NO: 1391934 - DNA, 22 bp, Artificial Sequence
  chemically synthesized
aattgtacataaaaaactggcc

SEQ ID NO: 1391935 - DNA, 22 bp, Artificial Sequence
  chemically synthesized
cattcaattgtacataaaaaac

SEQ ID NO: 1391936 - DNA, 22 bp, Artificial Sequence
  chemically synthesized
tacattcaattgtacataaaaa

SEQ ID NO: 1391937 - DNA, 22 bp, Artificial Sequence
  chemically synthesized
cctaggccagttttttatgtac

SEQ ID NO: 1391938 - DNA, 22 bp, Artificial Sequence
  chemically synthesized
ctacattcaattgtacataaaa

SEQ ID NO: 1391939 - DNA, 22 bp, Artificial Sequence
  chemically synthesized
ctaggccagttttttatgtaca

SEQ ID NO: 1391940 - DNA, 22 bp, Artificial Sequence
  chemically synthesized
tctacattcaattgtacataaa

SEQ ID NO: 1391941 - DNA, 22 bp, Artificial Sequence
  chemically synthesized
ggccagttttttatgtacaatt

SEQ ID NO: 1391942 - DNA, 22 bp, Artificial Sequence
  chemically synthesized
tagattttctacattcaattgt

SEQ ID NO: 1391943 - DNA, 22 bp, Artificial Sequence
  chemically synthesized
gtagattttctacattcaattg

SEQ ID NO: 1391944 - DNA, 22 bp, Artificial Sequence
  chemically synthesized
tgtagattttctacattcaatt

SEQ ID NO: 1391945 - DNA, 22 bp, Artificial Sequence
  chemically synthesized
ttgtagattttctacattcaat

SEQ ID NO: 1391946 - DNA, 22 bp, Artificial Sequence
  chemically synthesized
tttgtagattttctacattcaa

SEQ ID NO: 1391947 - DNA, 22 bp, Artificial Sequence
  chemically synthesized
tttatgtacaattgaatgtaga

SEQ ID NO: 1391948 - DNA, 22 bp, Artificial Sequence
  chemically synthesized
ttttgtagattttctacattca

SEQ ID NO: 1391949 - DNA, 22 bp, Artificial Sequence
  chemically synthesized
ttatgtacaattgaatgtagaa

SEQ ID NO: 1391950 - DNA, 22 bp, Artificial Sequence
  chemically synthesized
tatgtacaattgaatgtagaaa

SEQ ID NO: 1391951 - DNA, 22 bp, Artificial Sequence
  chemically synthesized
atgtacaattgaatgtagaaaa

SEQ ID NO: 1391952 - DNA, 22 bp, Artificial Sequence
  chemically synthesized
tttttttgtagattttctacat

SEQ ID NO: 1391953 - DNA, 22 bp, Artificial Sequence
  chemically synthesized
tgtacaattgaatgtagaaaat

SEQ ID NO: 1391954 - DNA, 22 bp, Artificial Sequence
  chemically synthesized
ctatttttttgtagattttcta

SEQ ID NO: 1391955 - DNA, 22 bp, Artificial Sequence
  chemically synthesized
tatcctactatttttttgtaga

SEQ ID NO: 1391956 - DNA, 22 bp, Artificial Sequence
  chemically synthesized
aatgtagaaaatctacaaaaaa

SEQ ID NO: 1391957 - DNA, 22 bp, Artificial Sequence
  chemically synthesized
caaaaaaatagtaggatacaat

SEQ ID NO: 1391958 - DNA, 22 bp, Artificial Sequence
  chemically synthesized
cagaatccaaaatccaggattg

SEQ ID NO: 1391959 - DNA, 22 bp, Artificial Sequence
  chemically synthesized
tctccagaatccaaaatccagg

SEQ ID NO: 1391960 - DNA, 22 bp, Artificial Sequence
  chemically synthesized
gattttggattctggagacagt

SEQ ID NO: 1391961 - DNA, 22 bp, Artificial Sequence
  chemically synthesized
tacaatgtggtccactgtctcc

SEQ ID NO: 1391962 - DNA, 22 bp, Artificial Sequence
  chemically synthesized
tggattctggagacagtggacc

SEQ ID NO: 1391963 - DNA, 22 bp, Artificial Sequence
  chemically synthesized
ggattctggagacagtggacca

SEQ ID NO: 1391964 - DNA, 22 bp, Artificial Sequence
  chemically synthesized
gattctggagacagtggaccac

SEQ ID NO: 1391965 - DNA, 22 bp, Artificial Sequence
  chemically synthesized
aatcacctatacaatgtggtcc

SEQ ID NO: 1391966 - DNA, 22 bp, Artificial Sequence
  chemically synthesized
tggagacagtggaccacattgt

SEQ ID NO: 1391967 - DNA, 22 bp, Artificial Sequence
  chemically synthesized
gagacagtggaccacattgtat

SEQ ID NO: 1391968 - DNA, 22 bp, Artificial Sequence
  chemically synthesized
attcaatcacctatacaatgtg

SEQ ID NO: 1391969 - DNA, 22 bp, Artificial Sequence
  chemically synthesized
attcattcaatcacctatacaa

SEQ ID NO: 1391970 - DNA, 22 bp, Artificial Sequence
  chemically synthesized
cattcattcaatcacctataca

SEQ ID NO: 1391971 - DNA, 22 bp, Artificial Sequence
  chemically synthesized
atttcattcattcaatcaccta

SEQ ID NO: 1391972 - DNA, 22 bp, Artificial Sequence
  chemically synthesized
tcatttcattcattcaatcacc

SEQ ID NO: 1391973 - DNA, 22 bp, Artificial Sequence
  chemically synthesized
ctcatttcattcattcaatcac

SEQ ID NO: 1391974 - DNA, 22 bp, Artificial Sequence
  chemically synthesized
tataggtgattgaatgaatgaa

SEQ ID NO: 1391975 - DNA, 22 bp, Artificial Sequence
  chemically synthesized
tatatcttctcatttcattcat

SEQ ID NO: 1391976 - DNA, 22 bp, Artificial Sequence
  chemically synthesized
atctatatatcttctcatttca

SEQ ID NO: 1391977 - DNA, 22 bp, Artificial Sequence
  chemically synthesized
catctatatatcttctcatttc

SEQ ID NO: 1391978 - DNA, 22 bp, Artificial Sequence
  chemically synthesized
ttcatctatatatcttctcatt

SEQ ID NO: 1391979 - DNA, 22 bp, Artificial Sequence
  chemically synthesized
cttcatctatatatcttctcat

SEQ ID NO: 1391980 - DNA, 22 bp, Artificial Sequence
  chemically synthesized
tcttcatctatatatcttctca

SEQ ID NO: 1391981 - DNA, 22 bp, Artificial Sequence
  chemically synthesized
aatgaatgaaatgagaagatat

SEQ ID NO: 1391982 - DNA, 22 bp, Artificial Sequence
  chemically synthesized
ttcttcatctatatatcttctc

SEQ ID NO: 1391983 - DNA, 22 bp, Artificial Sequence
  chemically synthesized
tttcttcatctatatatcttct

SEQ ID NO: 1391984 - DNA, 22 bp, Artificial Sequence
  chemically synthesized
ttttcttcatctatatatcttc

SEQ ID NO: 1391985 - DNA, 22 bp, Artificial Sequence
  chemically synthesized
tttttcttcatctatatatctt

SEQ ID NO: 1391986 - DNA, 22 bp, Artificial Sequence
  chemically synthesized
ttttttcttcatctatatatct

SEQ ID NO: 1391987 - DNA, 22 bp, Artificial Sequence
  chemically synthesized
ttttttttcttcatctatatat

SEQ ID NO: 1391988 - DNA, 22 bp, Artificial Sequence
  chemically synthesized
cttttttttcttcatctatata

SEQ ID NO: 1391989 - DNA, 22 bp, Artificial Sequence
  chemically synthesized
tcttttttttcttcatctatat

SEQ ID NO: 1391990 - DNA, 22 bp, Artificial Sequence
  chemically synthesized
tttcttttttttcttcatctat

SEQ ID NO: 1391991 - DNA, 22 bp, Artificial Sequence
  chemically synthesized
ctttcttttttttcttcatcta

SEQ ID NO: 1391992 - DNA, 22 bp, Artificial Sequence
  chemically synthesized
tctttcttttttttcttcatct

SEQ ID NO: 1391993 - DNA, 22 bp, Artificial Sequence
  chemically synthesized
tatattttctttcttttttttc

SEQ ID NO: 1391994 - DNA, 22 bp, Artificial Sequence
  chemically synthesized
gtatattttctttctttttttt

SEQ ID NO: 1391995 - DNA, 22 bp, Artificial Sequence
  chemically synthesized
tgtatattttctttcttttttt

SEQ ID NO: 1391996 - DNA, 22 bp, Artificial Sequence
  chemically synthesized
ctttgtatattttctttctttt

SEQ ID NO: 1391997 - DNA, 22 bp, Artificial Sequence
  chemically synthesized
ctcctttgtatattttctttct

SEQ ID NO: 1391998 - DNA, 22 bp, Artificial Sequence
  chemically synthesized
caatcatctcctcctttgtata

SEQ ID NO: 1391999 - DNA, 22 bp, Artificial Sequence
  chemically synthesized
ctccaatcatctcctcctttgt

SEQ ID NO: 1392000 - DNA, 22 bp, Artificial Sequence
  chemically synthesized
cctccaatcatctcctcctttg

SEQ ID NO: 1392001 - DNA, 22 bp, Artificial Sequence
  chemically synthesized
tcctccaatcatctcctccttt

SEQ ID NO: 1392002 - DNA, 22 bp, Artificial Sequence
  chemically synthesized
ttcctccaatcatctcctcctt

SEQ ID NO: 1392003 - DNA, 22 bp, Artificial Sequence
  chemically synthesized
tttttcctccaatcatctcctc

SEQ ID NO: 1392004 - DNA, 22 bp, Artificial Sequence
  chemically synthesized
gcatctgtttttcctccaatca

SEQ ID NO: 1392005 - DNA, 22 bp, Artificial Sequence
  chemically synthesized
tcctggcatctgtttttcctcc

SEQ ID NO: 1392006 - DNA, 22 bp, Artificial Sequence
  chemically synthesized
gtcctggcatctgtttttcctc

SEQ ID NO: 1392007 - DNA, 22 bp, Artificial Sequence
  chemically synthesized
agaatcttgtcctggcatctgt

SEQ ID NO: 1392008 - DNA, 22 bp, Artificial Sequence
  chemically synthesized
cagaatcttgtcctggcatctg

SEQ ID NO: 1392009 - DNA, 22 bp, Artificial Sequence
  chemically synthesized
gaggaaaaacagatgccaggac

SEQ ID NO: 1392010 - DNA, 22 bp, Artificial Sequence
  chemically synthesized
tgaagtatatatttttggtttt

SEQ ID NO: 1392011 - DNA, 22 bp, Artificial Sequence
  chemically synthesized
aagtatatatttttggttttgc

SEQ ID NO: 1392012 - DNA, 22 bp, Artificial Sequence
  chemically synthesized
ataggtgagggataaaagcaaa

SEQ ID NO: 1392013 - DNA, 22 bp, Artificial Sequence
  chemically synthesized
aataggtgagggataaaagcaa

SEQ ID NO: 1392014 - DNA, 22 bp, Artificial Sequence
  chemically synthesized
ttggttttgcttttatccctca

SEQ ID NO: 1392015 - DNA, 22 bp, Artificial Sequence
  chemically synthesized
tggttttgcttttatccctcac

SEQ ID NO: 1392016 - DNA, 22 bp, Artificial Sequence
  chemically synthesized
ggttttgcttttatccctcacc

SEQ ID NO: 1392017 - DNA, 22 bp, Artificial Sequence
  chemically synthesized
gttttgcttttatccctcacct

SEQ ID NO: 1392018 - DNA, 22 bp, Artificial Sequence
  chemically synthesized
tgcttttatccctcacctatta

SEQ ID NO: 1392019 - DNA, 22 bp, Artificial Sequence
  chemically synthesized
gcttttatccctcacctattaa

SEQ ID NO: 1392020 - DNA, 22 bp, Artificial Sequence
  chemically synthesized
cttttatccctcacctattaaa

SEQ ID NO: 1392021 - DNA, 22 bp, Artificial Sequence
  chemically synthesized
ttatccctcacctattaaaccc

SEQ ID NO: 1392022 - DNA, 22 bp, Artificial Sequence
  chemically synthesized
tatccctcacctattaaaccct

SEQ ID NO: 1392023 - DNA, 22 bp, Artificial Sequence
  chemically synthesized
atccctcacctattaaaccctg

SEQ ID NO: 1392024 - DNA, 22 bp, Artificial Sequence
  chemically synthesized
tccctcacctattaaaccctgt

SEQ ID NO: 1392025 - DNA, 22 bp, Artificial Sequence
  chemically synthesized
acctattaaaccctgtttcatt

SEQ ID NO: 1392026 - DNA, 22 bp, Artificial Sequence
  chemically synthesized
ttaaaccctgtttcatttgact

SEQ ID NO: 1392027 - DNA, 22 bp, Artificial Sequence
  chemically synthesized
gaaaatagagtaggagtcaaat

SEQ ID NO: 1392028 - DNA, 22 bp, Artificial Sequence
  chemically synthesized
aaccctgtttcatttgactcct

SEQ ID NO: 1392029 - DNA, 22 bp, Artificial Sequence
  chemically synthesized
tttcatttgactcctactctat

SEQ ID NO: 1392030 - DNA, 22 bp, Artificial Sequence
  chemically synthesized
catttgactcctactctatttt

SEQ ID NO: 1392031 - DNA, 22 bp, Artificial Sequence
  chemically synthesized
atttgactcctactctattttc

SEQ ID NO: 1392032 - DNA, 22 bp, Artificial Sequence
  chemically synthesized
gactcctactctattttctaac

SEQ ID NO: 1392033 - DNA, 22 bp, Artificial Sequence
  chemically synthesized
actcctactctattttctaacc

SEQ ID NO: 1392034 - DNA, 22 bp, Artificial Sequence
  chemically synthesized
ctactctattttctaacctcat

SEQ ID NO: 1392035 - DNA, 22 bp, Artificial Sequence
  chemically synthesized
ctctattttctaacctcatctc

SEQ ID NO: 1392036 - DNA, 22 bp, Artificial Sequence
  chemically synthesized
tattttctaacctcatctccca

SEQ ID NO: 1392037 - DNA, 22 bp, Artificial Sequence
  chemically synthesized
ttttctaacctcatctcccatt

SEQ ID NO: 1392038 - DNA, 22 bp, Artificial Sequence
  chemically synthesized
tctaacctcatctcccattgtt

SEQ ID NO: 1392039 - DNA, 22 bp, Artificial Sequence
  chemically synthesized
ctaacctcatctcccattgttg

SEQ ID NO: 1392040 - DNA, 22 bp, Artificial Sequence
  chemically synthesized
taacctcatctcccattgttgc

SEQ ID NO: 1392041 - DNA, 22 bp, Artificial Sequence
  chemically synthesized
acctcatctcccattgttgctc

SEQ ID NO: 1392042 - DNA, 22 bp, Artificial Sequence
  chemically synthesized
atctcccattgttgctcttacc

SEQ ID NO: 1392043 - DNA, 22 bp, Artificial Sequence
  chemically synthesized
gagtagagagggcaatggtaag

SEQ ID NO: 1392044 - DNA, 22 bp, Artificial Sequence
  chemically synthesized
ccattgttgctcttaccattgc

SEQ ID NO: 1392045 - DNA, 22 bp, Artificial Sequence
  chemically synthesized
ttgctcttaccattgccctctc

SEQ ID NO: 1392046 - DNA, 22 bp, Artificial Sequence
  chemically synthesized
tgtggttggagtagagagggca

SEQ ID NO: 1392047 - DNA, 22 bp, Artificial Sequence
  chemically synthesized
gtgtggttggagtagagagggc

SEQ ID NO: 1392048 - DNA, 22 bp, Artificial Sequence
  chemically synthesized
ctcttaccattgccctctctac

SEQ ID NO: 1392049 - DNA, 22 bp, Artificial Sequence
  chemically synthesized
ttaccattgccctctctactcc

SEQ ID NO: 1392050 - DNA, 22 bp, Artificial Sequence
  chemically synthesized
acttgtgtggttggagtagaga

SEQ ID NO: 1392051 - DNA, 22 bp, Artificial Sequence
  chemically synthesized
accattgccctctctactccaa

SEQ ID NO: 1392052 - DNA, 22 bp, Artificial Sequence
  chemically synthesized
ccattgccctctctactccaac

SEQ ID NO: 1392053 - DNA, 22 bp, Artificial Sequence
  chemically synthesized
ccctctctactccaaccacaca

SEQ ID NO: 1392054 - DNA, 22 bp, Artificial Sequence
  chemically synthesized
tctactccaaccacacaagtca

SEQ ID NO: 1392055 - DNA, 22 bp, Artificial Sequence
  chemically synthesized
tactccaaccacacaagtcaat

SEQ ID NO: 1392056 - DNA, 22 bp, Artificial Sequence
  chemically synthesized
ctccaaccacacaagtcaattt

SEQ ID NO: 1392057 - DNA, 22 bp, Artificial Sequence
  chemically synthesized
caaccacacaagtcaatttttc

SEQ ID NO: 1392058 - DNA, 22 bp, Artificial Sequence
  chemically synthesized
aaaaaagagaagcagaaaaatt

SEQ ID NO: 1392059 - DNA, 22 bp, Artificial Sequence
  chemically synthesized
ttctgcttctctttttttagtc

SEQ ID NO: 1392060 - DNA, 22 bp, Artificial Sequence
  chemically synthesized
tctgcttctctttttttagtcc

SEQ ID NO: 1392061 - DNA, 22 bp, Artificial Sequence
  chemically synthesized
ctgcttctctttttttagtcca

SEQ ID NO: 1392062 - DNA, 22 bp, Artificial Sequence
  chemically synthesized
tgcttctctttttttagtccat

SEQ ID NO: 1392063 - DNA, 22 bp, Artificial Sequence
  chemically synthesized
cttctctttttttagtccattc

SEQ ID NO: 1392064 - DNA, 22 bp, Artificial Sequence
  chemically synthesized
ctctttttttagtccattcctc

SEQ ID NO: 1392065 - DNA, 22 bp, Artificial Sequence
  chemically synthesized
tctttttttagtccattcctcc

SEQ ID NO: 1392066 - DNA, 22 bp, Artificial Sequence
  chemically synthesized
tttttttagtccattcctccct

SEQ ID NO: 1392067 - DNA, 22 bp, Artificial Sequence
  chemically synthesized
tttttagtccattcctcccttt

SEQ ID NO: 1392068 - DNA, 22 bp, Artificial Sequence
  chemically synthesized
ttttagtccattcctccctttg

SEQ ID NO: 1392069 - DNA, 22 bp, Artificial Sequence
  chemically synthesized
tttagtccattcctccctttgt

SEQ ID NO: 1392070 - DNA, 22 bp, Artificial Sequence
  chemically synthesized
ttagtccattcctccctttgtg

SEQ ID NO: 1392071 - DNA, 22 bp, Artificial Sequence
  chemically synthesized
tagtccattcctccctttgtgc

SEQ ID NO: 1392072 - DNA, 22 bp, Artificial Sequence
  chemically synthesized
agtccattcctccctttgtgct

SEQ ID NO: 1392073 - DNA, 22 bp, Artificial Sequence
  chemically synthesized
gtccattcctccctttgtgctt

SEQ ID NO: 1392074 - DNA, 22 bp, Artificial Sequence
  chemically synthesized
tatagggaaacaggaagcacaa

SEQ ID NO: 1392075 - DNA, 22 bp, Artificial Sequence
  chemically synthesized
tatatagggaaacaggaagcac

SEQ ID NO: 1392076 - DNA, 22 bp, Artificial Sequence
  chemically synthesized
ctccctttgtgcttcctgtttc

SEQ ID NO: 1392077 - DNA, 22 bp, Artificial Sequence
  chemically synthesized
cctttgtgcttcctgtttccct

SEQ ID NO: 1392078 - DNA, 22 bp, Artificial Sequence
  chemically synthesized
tgtgcttcctgtttccctatat

SEQ ID NO: 1392079 - DNA, 22 bp, Artificial Sequence
  chemically synthesized
gtgcttcctgtttccctatata

SEQ ID NO: 1392080 - DNA, 22 bp, Artificial Sequence
  chemically synthesized
tgcttcctgtttccctatatag

SEQ ID NO: 1392081 - DNA, 22 bp, Artificial Sequence
  chemically synthesized
gataacagaattctatataggg

SEQ ID NO: 1392082 - DNA, 22 bp, Artificial Sequence
  chemically synthesized
cctgtttccctatatagaattc

SEQ ID NO: 1392083 - DNA, 22 bp, Artificial Sequence
  chemically synthesized
ctgtttccctatatagaattct

SEQ ID NO: 1392084 - DNA, 22 bp, Artificial Sequence
  chemically synthesized
tttccctatatagaattctgtt

SEQ ID NO: 1392085 - DNA, 22 bp, Artificial Sequence
  chemically synthesized
ccctatatagaattctgttatc

SEQ ID NO: 1392086 - DNA, 22 bp, Artificial Sequence
  chemically synthesized
cctatatagaattctgttatcc

SEQ ID NO: 1392087 - DNA, 22 bp, Artificial Sequence
  chemically synthesized
tacatgtgatgatctggataac

SEQ ID NO: 1392088 - DNA, 22 bp, Artificial Sequence
  chemically synthesized
tatagaattctgttatccagat

SEQ ID NO: 1392089 - DNA, 22 bp, Artificial Sequence
  chemically synthesized
tgttatccagatcatcacatgt

SEQ ID NO: 1392090 - DNA, 22 bp, Artificial Sequence
  chemically synthesized
ttatccagatcatcacatgtat

SEQ ID NO: 1392091 - DNA, 22 bp, Artificial Sequence
  chemically synthesized
tccagatcatcacatgtatagg

SEQ ID NO: 1392092 - DNA, 22 bp, Artificial Sequence
  chemically synthesized
atacatgagataatagacagac

SEQ ID NO: 1392093 - DNA, 22 bp, Artificial Sequence
  chemically synthesized
agctgatacatgagataataga

SEQ ID NO: 1392094 - DNA, 22 bp, Artificial Sequence
  chemically synthesized
tctattatctcatgtatcagct

SEQ ID NO: 1392095 - DNA, 22 bp, Artificial Sequence
  chemically synthesized
ttatctcatgtatcagctcagc

SEQ ID NO: 1392096 - DNA, 22 bp, Artificial Sequence
  chemically synthesized
tgaagcagtgatagctgagctg

SEQ ID NO: 1392097 - DNA, 22 bp, Artificial Sequence
  chemically synthesized
tctcatgtatcagctcagctat

SEQ ID NO: 1392098 - DNA, 22 bp, Artificial Sequence
  chemically synthesized
atgtatcagctcagctatcact

SEQ ID NO: 1392099 - DNA, 22 bp, Artificial Sequence
  chemically synthesized
agctatcactgcttcatagtgg

SEQ ID NO: 1392100 - DNA, 22 bp, Artificial Sequence
  chemically synthesized
aaagaaaagggaaggccactat

SEQ ID NO: 1392101 - DNA, 22 bp, Artificial Sequence
  chemically synthesized
tcactgcttcatagtggccttc

SEQ ID NO: 1392102 - DNA, 22 bp, Artificial Sequence
  chemically synthesized
aattcaaagaaaagggaaggcc

SEQ ID NO: 1392103 - DNA, 22 bp, Artificial Sequence
  chemically synthesized
tcaattcaaagaaaagggaagg

SEQ ID NO: 1392104 - DNA, 22 bp, Artificial Sequence
  chemically synthesized
cttcatagtggccttccctttt

SEQ ID NO: 1392105 - DNA, 22 bp, Artificial Sequence
  chemically synthesized
ctcaattcaaagaaaagggaag

SEQ ID NO: 1392106 - DNA, 22 bp, Artificial Sequence
  chemically synthesized
catagtggccttcccttttctt

SEQ ID NO: 1392107 - DNA, 22 bp, Artificial Sequence
  chemically synthesized
atagtggccttcccttttcttt

SEQ ID NO: 1392108 - DNA, 22 bp, Artificial Sequence
  chemically synthesized
agggcttctcaattcaaagaaa

SEQ ID NO: 1392109 - DNA, 22 bp, Artificial Sequence
  chemically synthesized
aagggcttctcaattcaaagaa

SEQ ID NO: 1392110 - DNA, 22 bp, Artificial Sequence
  chemically synthesized
gatttaagggcttctcaattca

SEQ ID NO: 1392111 - DNA, 22 bp, Artificial Sequence
  chemically synthesized
cccttttctttgaattgagaag

SEQ ID NO: 1392112 - DNA, 22 bp, Artificial Sequence
  chemically synthesized
ccttttctttgaattgagaagc

SEQ ID NO: 1392113 - DNA, 22 bp, Artificial Sequence
  chemically synthesized
ttctttgaattgagaagccctt

SEQ ID NO: 1392114 - DNA, 22 bp, Artificial Sequence
  chemically synthesized
tctttgaattgagaagccctta

SEQ ID NO: 1392115 - DNA, 22 bp, Artificial Sequence
  chemically synthesized
ctttgaattgagaagcccttaa

SEQ ID NO: 1392116 - DNA, 22 bp, Artificial Sequence
  chemically synthesized
tttgaattgagaagcccttaaa

SEQ ID NO: 1392117 - DNA, 22 bp, Artificial Sequence
  chemically synthesized
tgaattgagaagcccttaaatc

SEQ ID NO: 1392118 - DNA, 22 bp, Artificial Sequence
  chemically synthesized
gaattgagaagcccttaaatcc

SEQ ID NO: 1392119 - DNA, 22 bp, Artificial Sequence
  chemically synthesized
aattgagaagcccttaaatcca

SEQ ID NO: 1392120 - DNA, 22 bp, Artificial Sequence
  chemically synthesized
tagtgagtgaatctggatttaa

SEQ ID NO: 1392121 - DNA, 22 bp, Artificial Sequence
  chemically synthesized
agaagcccttaaatccagattc

SEQ ID NO: 1392122 - DNA, 22 bp, Artificial Sequence
  chemically synthesized
aaatccagattcactcactata

SEQ ID NO: 1392123 - DNA, 22 bp, Artificial Sequence
  chemically synthesized
aatccagattcactcactatag

SEQ ID NO: 1392124 - DNA, 22 bp, Artificial Sequence
  chemically synthesized
agggataatcacataacctata

SEQ ID NO: 1392125 - DNA, 22 bp, Artificial Sequence
  chemically synthesized
gagggataatcacataacctat

SEQ ID NO: 1392126 - DNA, 22 bp, Artificial Sequence
  chemically synthesized
tgagggataatcacataaccta

SEQ ID NO: 1392127 - DNA, 22 bp, Artificial Sequence
  chemically synthesized
actcactataggttatgtgatt

SEQ ID NO: 1392128 - DNA, 22 bp, Artificial Sequence
  chemically synthesized
actataggttatgtgattatcc

SEQ ID NO: 1392129 - DNA, 22 bp, Artificial Sequence
  chemically synthesized
taggttatgtgattatccctca

SEQ ID NO: 1392130 - DNA, 22 bp, Artificial Sequence
  chemically synthesized
aagaatatgattttgagggata

SEQ ID NO: 1392131 - DNA, 22 bp, Artificial Sequence
  chemically synthesized
aaagaatatgattttgagggat

SEQ ID NO: 1392132 - DNA, 22 bp, Artificial Sequence
  chemically synthesized
tgtgattatccctcaaaatcat

SEQ ID NO: 1392133 - DNA, 22 bp, Artificial Sequence
  chemically synthesized
tccctcaaaatcatattcttta

SEQ ID NO: 1392134 - DNA, 22 bp, Artificial Sequence
  chemically synthesized
aaaatcatattctttaaatatt

SEQ ID NO: 1392135 - DNA, 22 bp, Artificial Sequence
  chemically synthesized
gtgagaaaagataaaaatcaaa

SEQ ID NO: 1392136 - DNA, 22 bp, Artificial Sequence
  chemically synthesized
ctagtgagaaaagataaaaatc

SEQ ID NO: 1392137 - DNA, 22 bp, Artificial Sequence
  chemically synthesized
tttaaatatttgatttttatct

SEQ ID NO: 1392138 - DNA, 22 bp, Artificial Sequence
  chemically synthesized
actagtgagaaaagataaaaat

SEQ ID NO: 1392139 - DNA, 22 bp, Artificial Sequence
  chemically synthesized
taaatatttgatttttatcttt

SEQ ID NO: 1392140 - DNA, 22 bp, Artificial Sequence
  chemically synthesized
aaatatttgatttttatctttt

SEQ ID NO: 1392141 - DNA, 22 bp, Artificial Sequence
  chemically synthesized
aatatttgatttttatcttttc

SEQ ID NO: 1392142 - DNA, 22 bp, Artificial Sequence
  chemically synthesized
gatttttatcttttctcactag

SEQ ID NO: 1392143 - DNA, 22 bp, Artificial Sequence
  chemically synthesized
atttttatcttttctcactagt

SEQ ID NO: 1392144 - DNA, 22 bp, Artificial Sequence
  chemically synthesized
acagagcatacttactagtgag

SEQ ID NO: 1392145 - DNA, 22 bp, Artificial Sequence
  chemically synthesized
cacagagcatacttactagtga

SEQ ID NO: 1392146 - DNA, 22 bp, Artificial Sequence
  chemically synthesized
tcacagagcatacttactagtg

SEQ ID NO: 1392147 - DNA, 22 bp, Artificial Sequence
  chemically synthesized
ttatcttttctcactagtaagt

SEQ ID NO: 1392148 - DNA, 22 bp, Artificial Sequence
  chemically synthesized
tatcttttctcactagtaagta

SEQ ID NO: 1392149 - DNA, 22 bp, Artificial Sequence
  chemically synthesized
atcttttctcactagtaagtat

SEQ ID NO: 1392150 - DNA, 22 bp, Artificial Sequence
  chemically synthesized
tcttttctcactagtaagtatg

SEQ ID NO: 1392151 - DNA, 22 bp, Artificial Sequence
  chemically synthesized
gttttcacagagcatacttact

SEQ ID NO: 1392152 - DNA, 22 bp, Artificial Sequence
  chemically synthesized
ttctcactagtaagtatgctct

SEQ ID NO: 1392153 - DNA, 22 bp, Artificial Sequence
  chemically synthesized
tctcactagtaagtatgctctg

SEQ ID NO: 1392154 - DNA, 22 bp, Artificial Sequence
  chemically synthesized
ctcactagtaagtatgctctgt

SEQ ID NO: 1392155 - DNA, 22 bp, Artificial Sequence
  chemically synthesized
tcactagtaagtatgctctgtg

SEQ ID NO: 1392156 - DNA, 22 bp, Artificial Sequence
  chemically synthesized
actagtaagtatgctctgtgaa

SEQ ID NO: 1392157 - DNA, 22 bp, Artificial Sequence
  chemically synthesized
gtaagtatgctctgtgaaaacc

SEQ ID NO: 1392158 - DNA, 22 bp, Artificial Sequence
  chemically synthesized
gggtgaaaaagagacatcgcct

SEQ ID NO: 1392159 - DNA, 22 bp, Artificial Sequence
  chemically synthesized
tgtgaaaaccaggcgatgtctc

SEQ ID NO: 1392160 - DNA, 22 bp, Artificial Sequence
  chemically synthesized
tgaaaaccaggcgatgtctctt

SEQ ID NO: 1392161 - DNA, 22 bp, Artificial Sequence
  chemically synthesized
acaggtctagggtgaaaaagag

SEQ ID NO: 1392162 - DNA, 22 bp, Artificial Sequence
  chemically synthesized
ggcactgacaggtctagggtga

SEQ ID NO: 1392163 - DNA, 22 bp, Artificial Sequence
  chemically synthesized
tattaggcactgacaggtctag

SEQ ID NO: 1392164 - DNA, 22 bp, Artificial Sequence
  chemically synthesized
tttttcaccctagacctgtcag

SEQ ID NO: 1392165 - DNA, 22 bp, Artificial Sequence
  chemically synthesized
tttcaccctagacctgtcagtg

SEQ ID NO: 1392166 - DNA, 22 bp, Artificial Sequence
  chemically synthesized
ttcaccctagacctgtcagtgc

SEQ ID NO: 1392167 - DNA, 22 bp, Artificial Sequence
  chemically synthesized
tcaccctagacctgtcagtgcc

SEQ ID NO: 1392168 - DNA, 22 bp, Artificial Sequence
  chemically synthesized
caccctagacctgtcagtgcct

SEQ ID NO: 1392169 - DNA, 22 bp, Artificial Sequence
  chemically synthesized
accctagacctgtcagtgccta

SEQ ID NO: 1392170 - DNA, 22 bp, Artificial Sequence
  chemically synthesized
tagccaaggtactatattaggc

SEQ ID NO: 1392171 - DNA, 22 bp, Artificial Sequence
  chemically synthesized
gacctgtcagtgcctaatatag

SEQ ID NO: 1392172 - DNA, 22 bp, Artificial Sequence
  chemically synthesized
ctatagccaaggtactatatta

SEQ ID NO: 1392173 - DNA, 22 bp, Artificial Sequence
  chemically synthesized
tcagtgcctaatatagtacctt

SEQ ID NO: 1392174 - DNA, 22 bp, Artificial Sequence
  chemically synthesized
acaacctgctatagccaaggta

SEQ ID NO: 1392175 - DNA, 22 bp, Artificial Sequence
  chemically synthesized
atatagtaccttggctatagca

SEQ ID NO: 1392176 - DNA, 22 bp, Artificial Sequence
  chemically synthesized
ggctatagcaggttgtcagtga

SEQ ID NO: 1392177 - DNA, 22 bp, Artificial Sequence
  chemically synthesized
gctatagcaggttgtcagtgac

SEQ ID NO: 1392178 - DNA, 22 bp, Artificial Sequence
  chemically synthesized
aatgaatgcaagagtcactgac

SEQ ID NO: 1392179 - DNA, 22 bp, Artificial Sequence
  chemically synthesized
tagcaggttgtcagtgactctt

SEQ ID NO: 1392180 - DNA, 22 bp, Artificial Sequence
  chemically synthesized
atctcaatgaatgcaagagtca

SEQ ID NO: 1392181 - DNA, 22 bp, Artificial Sequence
  chemically synthesized
taatctcaatgaatgcaagagt

SEQ ID NO: 1392182 - DNA, 22 bp, Artificial Sequence
  chemically synthesized
agttctaatctcaatgaatgca

SEQ ID NO: 1392183 - DNA, 22 bp, Artificial Sequence
  chemically synthesized
tcagtgactcttgcattcattg

SEQ ID NO: 1392184 - DNA, 22 bp, Artificial Sequence
  chemically synthesized
tagctcagttctaatctcaatg

SEQ ID NO: 1392185 - DNA, 22 bp, Artificial Sequence
  chemically synthesized
gtagctcagttctaatctcaat

SEQ ID NO: 1392186 - DNA, 22 bp, Artificial Sequence
  chemically synthesized
ttgcattcattgagattagaac

SEQ ID NO: 1392187 - DNA, 22 bp, Artificial Sequence
  chemically synthesized
gcattcattgagattagaactg

SEQ ID NO: 1392188 - DNA, 22 bp, Artificial Sequence
  chemically synthesized
tcacttgtagctcagttctaat

SEQ ID NO: 1392189 - DNA, 22 bp, Artificial Sequence
  chemically synthesized
cattcattgagattagaactga

SEQ ID NO: 1392190 - DNA, 22 bp, Artificial Sequence
  chemically synthesized
tgtcacttgtagctcagttcta

SEQ ID NO: 1392191 - DNA, 22 bp, Artificial Sequence
  chemically synthesized
ctgtcacttgtagctcagttct

SEQ ID NO: 1392192 - DNA, 22 bp, Artificial Sequence
  chemically synthesized
tctgtcacttgtagctcagttc

SEQ ID NO: 1392193 - DNA, 22 bp, Artificial Sequence
  chemically synthesized
attgagattagaactgagctac

SEQ ID NO: 1392194 - DNA, 22 bp, Artificial Sequence
  chemically synthesized
gattttctgtcacttgtagctc

SEQ ID NO: 1392195 - DNA, 22 bp, Artificial Sequence
  chemically synthesized
agattagaactgagctacaagt

SEQ ID NO: 1392196 - DNA, 22 bp, Artificial Sequence
  chemically synthesized
ggattttctgtcacttgtagct

SEQ ID NO: 1392197 - DNA, 22 bp, Artificial Sequence
  chemically synthesized
tggattttctgtcacttgtagc

SEQ ID NO: 1392198 - DNA, 22 bp, Artificial Sequence
  chemically synthesized
ttttggattttctgtcacttgt

SEQ ID NO: 1392199 - DNA, 22 bp, Artificial Sequence
  chemically synthesized
gaactgagctacaagtgacaga

SEQ ID NO: 1392200 - DNA, 22 bp, Artificial Sequence
  chemically synthesized
gttattttggattttctgtcac

SEQ ID NO: 1392201 - DNA, 22 bp, Artificial Sequence
  chemically synthesized
agctacaagtgacagaaaatcc

SEQ ID NO: 1392202 - DNA, 22 bp, Artificial Sequence
  chemically synthesized
atattggttattttggattttc

SEQ ID NO: 1392203 - DNA, 22 bp, Artificial Sequence
  chemically synthesized
caagtgacagaaaatccaaaat

SEQ ID NO: 1392204 - DNA, 22 bp, Artificial Sequence
  chemically synthesized
ctgatattggttattttggatt

SEQ ID NO: 1392205 - DNA, 22 bp, Artificial Sequence
  chemically synthesized
ttcctgatattggttattttgg

SEQ ID NO: 1392206 - DNA, 22 bp, Artificial Sequence
  chemically synthesized
cattgttcctgatattggttat

SEQ ID NO: 1392207 - DNA, 22 bp, Artificial Sequence
  chemically synthesized
ccattgttcctgatattggtta

SEQ ID NO: 1392208 - DNA, 22 bp, Artificial Sequence
  chemically synthesized
agaaagatgcaaacttccattg

SEQ ID NO: 1392209 - DNA, 22 bp, Artificial Sequence
  chemically synthesized
cagaaagatgcaaacttccatt

SEQ ID NO: 1392210 - DNA, 22 bp, Artificial Sequence
  chemically synthesized
tttcagaaagatgcaaacttcc

SEQ ID NO: 1392211 - DNA, 22 bp, Artificial Sequence
  chemically synthesized
atttcagaaagatgcaaacttc

SEQ ID NO: 1392212 - DNA, 22 bp, Artificial Sequence
  chemically synthesized
ttatttcagaaagatgcaaact

SEQ ID NO: 1392213 - DNA, 22 bp, Artificial Sequence
  chemically synthesized
cttatttcagaaagatgcaaac

SEQ ID NO: 1392214 - DNA, 22 bp, Artificial Sequence
  chemically synthesized
ttcttatttcagaaagatgcaa

SEQ ID NO: 1392215 - DNA, 22 bp, Artificial Sequence
  chemically synthesized
tctcttcttatttcagaaagat

SEQ ID NO: 1392216 - DNA, 22 bp, Artificial Sequence
  chemically synthesized
aactgtctcttcttatttcaga

SEQ ID NO: 1392217 - DNA, 22 bp, Artificial Sequence
  chemically synthesized
tcaactgtctcttcttatttca

SEQ ID NO: 1392218 - DNA, 22 bp, Artificial Sequence
  chemically synthesized
gcatctttctgaaataagaaga

SEQ ID NO: 1392219 - DNA, 22 bp, Artificial Sequence
  chemically synthesized
catctttctgaaataagaagag

SEQ ID NO: 1392220 - DNA, 22 bp, Artificial Sequence
  chemically synthesized
cctctcaactgtctcttcttat

SEQ ID NO: 1392221 - DNA, 22 bp, Artificial Sequence
  chemically synthesized
tactgcctctcaactgtctctt

SEQ ID NO: 1392222 - DNA, 22 bp, Artificial Sequence
  chemically synthesized
tctgaaataagaagagacagtt

SEQ ID NO: 1392223 - DNA, 22 bp, Artificial Sequence
  chemically synthesized
ctgaaataagaagagacagttg

SEQ ID NO: 1392224 - DNA, 22 bp, Artificial Sequence
  chemically synthesized
tgaaataagaagagacagttga

SEQ ID NO: 1392225 - DNA, 22 bp, Artificial Sequence
  chemically synthesized
aaataagaagagacagttgaga

SEQ ID NO: 1392226 - DNA, 22 bp, Artificial Sequence
  chemically synthesized
atgatcatggagccactgtact

SEQ ID NO: 1392227 - DNA, 22 bp, Artificial Sequence
  chemically synthesized
agaggcagtacagtggctccat

SEQ ID NO: 1392228 - DNA, 22 bp, Artificial Sequence
  chemically synthesized
tccaatgtccctgatgatcatg

SEQ ID NO: 1392229 - DNA, 22 bp, Artificial Sequence
  chemically synthesized
catgatcatcagggacattgga

SEQ ID NO: 1392230 - DNA, 22 bp, Artificial Sequence
  chemically synthesized
ataatataaattgtccaatgtc

SEQ ID NO: 1392231 - DNA, 22 bp, Artificial Sequence
  chemically synthesized
aagaagacaaactaataatata

SEQ ID NO: 1392232 - DNA, 22 bp, Artificial Sequence
  chemically synthesized
gacaatttatattattagtttg

SEQ ID NO: 1392233 - DNA, 22 bp, Artificial Sequence
  chemically synthesized
tatgttgaagaagacaaactaa

SEQ ID NO: 1392234 - DNA, 22 bp, Artificial Sequence
  chemically synthesized
atattattagtttgtcttcttc

SEQ ID NO: 1392235 - DNA, 22 bp, Artificial Sequence
  chemically synthesized
tattattagtttgtcttcttca

SEQ ID NO: 1392236 - DNA, 22 bp, Artificial Sequence
  chemically synthesized
ttagtttgtcttcttcaacata

SEQ ID NO: 1392237 - DNA, 22 bp, Artificial Sequence
  chemically synthesized
caaaatggaagttgtatgttga

SEQ ID NO: 1392238 - DNA, 22 bp, Artificial Sequence
  chemically synthesized
gtttgtcttcttcaacatacaa

SEQ ID NO: 1392239 - DNA, 22 bp, Artificial Sequence
  chemically synthesized
gtcttcttcaacatacaacttc

SEQ ID NO: 1392240 - DNA, 22 bp, Artificial Sequence
  chemically synthesized
gactacaaaatggaagttgtat

SEQ ID NO: 1392241 - DNA, 22 bp, Artificial Sequence
  chemically synthesized
tcttcttcaacatacaacttcc

SEQ ID NO: 1392242 - DNA, 22 bp, Artificial Sequence
  chemically synthesized
cttcaacatacaacttccattt

SEQ ID NO: 1392243 - DNA, 22 bp, Artificial Sequence
  chemically synthesized
ttcaacatacaacttccatttt

SEQ ID NO: 1392244 - DNA, 22 bp, Artificial Sequence
  chemically synthesized
caacatacaacttccattttgt

SEQ ID NO: 1392245 - DNA, 22 bp, Artificial Sequence
  chemically synthesized
aacatacaacttccattttgta

SEQ ID NO: 1392246 - DNA, 22 bp, Artificial Sequence
  chemically synthesized
aatagccatctggactacaaaa

SEQ ID NO: 1392247 - DNA, 22 bp, Artificial Sequence
  chemically synthesized
gaatagccatctggactacaaa

SEQ ID NO: 1392248 - DNA, 22 bp, Artificial Sequence
  chemically synthesized
gagcttgaatagccatctggac

SEQ ID NO: 1392249 - DNA, 22 bp, Artificial Sequence
  chemically synthesized
ccattttgtagtccagatggct

SEQ ID NO: 1392250 - DNA, 22 bp, Artificial Sequence
  chemically synthesized
cattttgtagtccagatggcta

SEQ ID NO: 1392251 - DNA, 22 bp, Artificial Sequence
  chemically synthesized
tgtagtccagatggctattcaa

SEQ ID NO: 1392252 - DNA, 22 bp, Artificial Sequence
  chemically synthesized
gtagtccagatggctattcaag

SEQ ID NO: 1392253 - DNA, 22 bp, Artificial Sequence
  chemically synthesized
tagtccagatggctattcaagc

SEQ ID NO: 1392254 - DNA, 22 bp, Artificial Sequence
  chemically synthesized
gatggcaatgtgatgattggag

SEQ ID NO: 1392255 - DNA, 22 bp, Artificial Sequence
  chemically synthesized
ggatggcaatgtgatgattgga

SEQ ID NO: 1392256 - DNA, 22 bp, Artificial Sequence
  chemically synthesized
cttggatggcaatgtgatgatt

SEQ ID NO: 1392257 - DNA, 22 bp, Artificial Sequence
  chemically synthesized
ttcaagctccaatcatcacatt

SEQ ID NO: 1392258 - DNA, 22 bp, Artificial Sequence
  chemically synthesized
ttacttggatggcaatgtgatg

SEQ ID NO: 1392259 - DNA, 22 bp, Artificial Sequence
  chemically synthesized
aagctccaatcatcacattgcc

SEQ ID NO: 1392260 - DNA, 22 bp, Artificial Sequence
  chemically synthesized
actgttacttggatggcaatgt

SEQ ID NO: 1392261 - DNA, 22 bp, Artificial Sequence
  chemically synthesized
tcactgttacttggatggcaat

SEQ ID NO: 1392262 - DNA, 22 bp, Artificial Sequence
  chemically synthesized
ctcactgttacttggatggcaa

SEQ ID NO: 1392263 - DNA, 22 bp, Artificial Sequence
  chemically synthesized
caatcatcacattgccatccaa

SEQ ID NO: 1392264 - DNA, 22 bp, Artificial Sequence
  chemically synthesized
tttctcactgttacttggatgg

SEQ ID NO: 1392265 - DNA, 22 bp, Artificial Sequence
  chemically synthesized
ttatttctcactgttacttgga

SEQ ID NO: 1392266 - DNA, 22 bp, Artificial Sequence
  chemically synthesized
gttatttctcactgttacttgg

SEQ ID NO: 1392267 - DNA, 22 bp, Artificial Sequence
  chemically synthesized
cttgttatttctcactgttact

SEQ ID NO: 1392268 - DNA, 22 bp, Artificial Sequence
  chemically synthesized
ccttgttatttctcactgttac

SEQ ID NO: 1392269 - DNA, 22 bp, Artificial Sequence
  chemically synthesized
ccatccaagtaacagtgagaaa

SEQ ID NO: 1392270 - DNA, 22 bp, Artificial Sequence
  chemically synthesized
tcttccttgttatttctcactg

SEQ ID NO: 1392271 - DNA, 22 bp, Artificial Sequence
  chemically synthesized
ccctatcttccttgttatttct

SEQ ID NO: 1392272 - DNA, 22 bp, Artificial Sequence
  chemically synthesized
cccctatcttccttgttatttc

SEQ ID NO: 1392273 - DNA, 22 bp, Artificial Sequence
  chemically synthesized
ggaagagaagtccatcttcccc

SEQ ID NO: 1392274 - DNA, 22 bp, Artificial Sequence
  chemically synthesized
taggaagagaagtccatcttcc

SEQ ID NO: 1392275 - DNA, 22 bp, Artificial Sequence
  chemically synthesized
ctaggaagagaagtccatcttc

SEQ ID NO: 1392276 - DNA, 22 bp, Artificial Sequence
  chemically synthesized
atgtgtgaaacttctaggaaga

SEQ ID NO: 1392277 - DNA, 22 bp, Artificial Sequence
  chemically synthesized
ctcttcctagaagtttcacaca

SEQ ID NO: 1392278 - DNA, 22 bp, Artificial Sequence
  chemically synthesized
tcttcctagaagtttcacacat

SEQ ID NO: 1392279 - DNA, 22 bp, Artificial Sequence
  chemically synthesized
ttcctagaagtttcacacatta

SEQ ID NO: 1392280 - DNA, 22 bp, Artificial Sequence
  chemically synthesized
cctagaagtttcacacattaat

SEQ ID NO: 1392281 - DNA, 22 bp, Artificial Sequence
  chemically synthesized
ctagaagtttcacacattaatt

SEQ ID NO: 1392282 - DNA, 22 bp, Artificial Sequence
  chemically synthesized
gaagtttcacacattaattctt

SEQ ID NO: 1392283 - DNA, 22 bp, Artificial Sequence
  chemically synthesized
ataggacataataagaattaat

SEQ ID NO: 1392284 - DNA, 22 bp, Artificial Sequence
  chemically synthesized
tgataggacataataagaatta

SEQ ID NO: 1392285 - DNA, 22 bp, Artificial Sequence
  chemically synthesized
gttctgataggacataataaga

SEQ ID NO: 1392286 - DNA, 22 bp, Artificial Sequence
  chemically synthesized
cacacattaattcttattatgt

SEQ ID NO: 1392287 - DNA, 22 bp, Artificial Sequence
  chemically synthesized
acacattaattcttattatgtc

SEQ ID NO: 1392288 - DNA, 22 bp, Artificial Sequence
  chemically synthesized
attcttattatgtcctatcaga

SEQ ID NO: 1392289 - DNA, 22 bp, Artificial Sequence
  chemically synthesized
ttattatgtcctatcagaacca

SEQ ID NO: 1392290 - DNA, 22 bp, Artificial Sequence
  chemically synthesized
attatgtcctatcagaaccagg

SEQ ID NO: 1392291 - DNA, 22 bp, Artificial Sequence
  chemically synthesized
ttatgtcctatcagaaccaggt

SEQ ID NO: 1392292 - DNA, 22 bp, Artificial Sequence
  chemically synthesized
ggtatgatcatgtgacctggtt

SEQ ID NO: 1392293 - DNA, 22 bp, Artificial Sequence
  chemically synthesized
tgtcctatcagaaccaggtcac

SEQ ID NO: 1392294 - DNA, 22 bp, Artificial Sequence
  chemically synthesized
cagctaggtatgatcatgtgac

SEQ ID NO: 1392295 - DNA, 22 bp, Artificial Sequence
  chemically synthesized
tcagaaccaggtcacatgatca

SEQ ID NO: 1392296 - DNA, 22 bp, Artificial Sequence
  chemically synthesized
cattgcagctaggtatgatcat

SEQ ID NO: 1392297 - DNA, 22 bp, Artificial Sequence
  chemically synthesized
atcctccattgcagctaggtat

SEQ ID NO: 1392298 - DNA, 22 bp, Artificial Sequence
  chemically synthesized
catcctccattgcagctaggta

SEQ ID NO: 1392299 - DNA, 22 bp, Artificial Sequence
  chemically synthesized
tcatcctccattgcagctaggt

SEQ ID NO: 1392300 - DNA, 22 bp, Artificial Sequence
  chemically synthesized
ttcatcctccattgcagctagg

SEQ ID NO: 1392301 - DNA, 22 bp, Artificial Sequence
  chemically synthesized
aatttttcatcctccattgcag

SEQ ID NO: 1392302 - DNA, 22 bp, Artificial Sequence
  chemically synthesized
aaatttttcatcctccattgca

SEQ ID NO: 1392303 - DNA, 22 bp, Artificial Sequence
  chemically synthesized
gctgcaatggaggatgaaaaat

SEQ ID NO: 1392304 - DNA, 22 bp, Artificial Sequence
  chemically synthesized
caataaagtttaaatttttcat

SEQ ID NO: 1392305 - DNA, 22 bp, Artificial Sequence
  chemically synthesized
caatggaggatgaaaaatttaa

SEQ ID NO: 1392306 - DNA, 22 bp, Artificial Sequence
  chemically synthesized
aatgaacatcctacaataaagt

SEQ ID NO: 1392307 - DNA, 22 bp, Artificial Sequence
  chemically synthesized
aaatgaacatcctacaataaag

SEQ ID NO: 1392308 - DNA, 22 bp, Artificial Sequence
  chemically synthesized
aaactttattgtaggatgttca

SEQ ID NO: 1392309 - DNA, 22 bp, Artificial Sequence
  chemically synthesized
aactttattgtaggatgttcat

SEQ ID NO: 1392310 - DNA, 22 bp, Artificial Sequence
  chemically synthesized
tattgtaggatgttcatttaag

SEQ ID NO: 1392311 - DNA, 22 bp, Artificial Sequence
  chemically synthesized
attgtaggatgttcatttaagc

SEQ ID NO: 1392312 - DNA, 22 bp, Artificial Sequence
  chemically synthesized
ttgtaggatgttcatttaagcc

SEQ ID NO: 1392313 - DNA, 22 bp, Artificial Sequence
  chemically synthesized
taggatgttcatttaagccctc

SEQ ID NO: 1392314 - DNA, 22 bp, Artificial Sequence
  chemically synthesized
gaggcaggtatcgagagagggc

SEQ ID NO: 1392315 - DNA, 22 bp, Artificial Sequence
  chemically synthesized
gcctagaggcaggtatcgagag

SEQ ID NO: 1392316 - DNA, 22 bp, Artificial Sequence
  chemically synthesized
atttaagccctctctcgatacc

SEQ ID NO: 1392317 - DNA, 22 bp, Artificial Sequence
  chemically synthesized
agcctagaggcaggtatcgaga

SEQ ID NO: 1392318 - DNA, 22 bp, Artificial Sequence
  chemically synthesized
aagccctctctcgatacctgcc

SEQ ID NO: 1392319 - DNA, 22 bp, Artificial Sequence
  chemically synthesized
agccctctctcgatacctgcct

SEQ ID NO: 1392320 - DNA, 22 bp, Artificial Sequence
  chemically synthesized
tatgtttagcctagaggcaggt

SEQ ID NO: 1392321 - DNA, 22 bp, Artificial Sequence
  chemically synthesized
atatgtttagcctagaggcagg

SEQ ID NO: 1392322 - DNA, 22 bp, Artificial Sequence
  chemically synthesized
tatatgtttagcctagaggcag

SEQ ID NO: 1392323 - DNA, 22 bp, Artificial Sequence
  chemically synthesized
ttatatgtttagcctagaggca

SEQ ID NO: 1392324 - DNA, 22 bp, Artificial Sequence
  chemically synthesized
tctcgatacctgcctctaggct

SEQ ID NO: 1392325 - DNA, 22 bp, Artificial Sequence
  chemically synthesized
cttttatatgtttagcctagag

SEQ ID NO: 1392326 - DNA, 22 bp, Artificial Sequence
  chemically synthesized
tcgatacctgcctctaggctaa

SEQ ID NO: 1392327 - DNA, 22 bp, Artificial Sequence
  chemically synthesized
gatacctgcctctaggctaaac

SEQ ID NO: 1392328 - DNA, 22 bp, Artificial Sequence
  chemically synthesized
cctctaggctaaacatataaaa

SEQ ID NO: 1392329 - DNA, 22 bp, Artificial Sequence
  chemically synthesized
taggctaaacatataaaaggaa

SEQ ID NO: 1392330 - DNA, 22 bp, Artificial Sequence
  chemically synthesized
gtgagaaacgggttccttttat

SEQ ID NO: 1392331 - DNA, 22 bp, Artificial Sequence
  chemically synthesized
ggctaaacatataaaaggaacc

SEQ ID NO: 1392332 - DNA, 22 bp, Artificial Sequence
  chemically synthesized
aacatataaaaggaacccgttt

SEQ ID NO: 1392333 - DNA, 22 bp, Artificial Sequence
  chemically synthesized
gggtgagttagtgagaaacggg

SEQ ID NO: 1392334 - DNA, 22 bp, Artificial Sequence
  chemically synthesized
ggggtgagttagtgagaaacgg

SEQ ID NO: 1392335 - DNA, 22 bp, Artificial Sequence
  chemically synthesized
gtttggggtgagttagtgagaa

SEQ ID NO: 1392336 - DNA, 22 bp, Artificial Sequence
  chemically synthesized
ttggtttggggtgagttagtga

SEQ ID NO: 1392337 - DNA, 22 bp, Artificial Sequence
  chemically synthesized
tgaattattggtttggggtgag

SEQ ID NO: 1392338 - DNA, 22 bp, Artificial Sequence
  chemically synthesized
ctcactaactcaccccaaacca

SEQ ID NO: 1392339 - DNA, 22 bp, Artificial Sequence
  chemically synthesized
tcactaactcaccccaaaccaa

SEQ ID NO: 1392340 - DNA, 22 bp, Artificial Sequence
  chemically synthesized
cactatgaattattggtttggg

SEQ ID NO: 1392341 - DNA, 22 bp, Artificial Sequence
  chemically synthesized
actaactcaccccaaaccaata

SEQ ID NO: 1392342 - DNA, 22 bp, Artificial Sequence
  chemically synthesized
gctacactatgaattattggtt

SEQ ID NO: 1392343 - DNA, 22 bp, Artificial Sequence
  chemically synthesized
actcaccccaaaccaataattc

SEQ ID NO: 1392344 - DNA, 22 bp, Artificial Sequence
  chemically synthesized
accccaaaccaataattcatag

SEQ ID NO: 1392345 - DNA, 22 bp, Artificial Sequence
  chemically synthesized
atattagctacactatgaatta

SEQ ID NO: 1392346 - DNA, 22 bp, Artificial Sequence
  chemically synthesized
aatattagctacactatgaatt

SEQ ID NO: 1392347 - DNA, 22 bp, Artificial Sequence
  chemically synthesized
gacacatacttaatattagcta

SEQ ID NO: 1392348 - DNA, 22 bp, Artificial Sequence
  chemically synthesized
ggacacatacttaatattagct

SEQ ID NO: 1392349 - DNA, 22 bp, Artificial Sequence
  chemically synthesized
tggacacatacttaatattagc

SEQ ID NO: 1392350 - DNA, 22 bp, Artificial Sequence
  chemically synthesized
ttggacacatacttaatattag

SEQ ID NO: 1392351 - DNA, 22 bp, Artificial Sequence
  chemically synthesized
atagtgtagctaatattaagta

SEQ ID NO: 1392352 - DNA, 22 bp, Artificial Sequence
  chemically synthesized
ccttttggacacatacttaata

SEQ ID NO: 1392353 - DNA, 22 bp, Artificial Sequence
  chemically synthesized
tctaccttttggacacatactt

SEQ ID NO: 1392354 - DNA, 22 bp, Artificial Sequence
  chemically synthesized
atattaagtatgtgtccaaaag

SEQ ID NO: 1392355 - DNA, 22 bp, Artificial Sequence
  chemically synthesized
ggcagttatctaccttttggac

SEQ ID NO: 1392356 - DNA, 22 bp, Artificial Sequence
  chemically synthesized
gggcagttatctaccttttgga

SEQ ID NO: 1392357 - DNA, 22 bp, Artificial Sequence
  chemically synthesized
agtatgtgtccaaaaggtagat

SEQ ID NO: 1392358 - DNA, 22 bp, Artificial Sequence
  chemically synthesized
gtgaggaagaatataaaacgtt

SEQ ID NO: 1392359 - DNA, 22 bp, Artificial Sequence
  chemically synthesized
ggtgaggaagaatataaaacgt

SEQ ID NO: 1392360 - DNA, 22 bp, Artificial Sequence
  chemically synthesized
ttggtgaggaagaatataaaac

SEQ ID NO: 1392361 - DNA, 22 bp, Artificial Sequence
  chemically synthesized
cctcttggtgaggaagaatata

SEQ ID NO: 1392362 - DNA, 22 bp, Artificial Sequence
  chemically synthesized
cccaaacgttttatattcttcc

SEQ ID NO: 1392363 - DNA, 22 bp, Artificial Sequence
  chemically synthesized
acctcttggtgaggaagaatat

SEQ ID NO: 1392364 - DNA, 22 bp, Artificial Sequence
  chemically synthesized
tacctcttggtgaggaagaata

SEQ ID NO: 1392365 - DNA, 22 bp, Artificial Sequence
  chemically synthesized
accctttacctcttggtgagga

SEQ ID NO: 1392366 - DNA, 22 bp, Artificial Sequence
  chemically synthesized
tatattcttcctcaccaagagg

SEQ ID NO: 1392367 - DNA, 22 bp, Artificial Sequence
  chemically synthesized
atattcttcctcaccaagaggt

SEQ ID NO: 1392368 - DNA, 22 bp, Artificial Sequence
  chemically synthesized
tattcttcctcaccaagaggta

SEQ ID NO: 1392369 - DNA, 22 bp, Artificial Sequence
  chemically synthesized
ttcctcaccaagaggtaaaggg

SEQ ID NO: 1392370 - DNA, 22 bp, Artificial Sequence
  chemically synthesized
cctcaccaagaggtaaagggtc

SEQ ID NO: 1392371 - DNA, 22 bp, Artificial Sequence
  chemically synthesized
ctcaccaagaggtaaagggtca

SEQ ID NO: 1392372 - DNA, 22 bp, Artificial Sequence
  chemically synthesized
accaagaggtaaagggtcaact

SEQ ID NO: 1392373 - DNA, 22 bp, Artificial Sequence
  chemically synthesized
acatgcagaagaatgaagttga

SEQ ID NO: 1392374 - DNA, 22 bp, Artificial Sequence
  chemically synthesized
agattcacatgcagaagaatga

SEQ ID NO: 1392375 - DNA, 22 bp, Artificial Sequence
  chemically synthesized
gagattcacatgcagaagaatg

SEQ ID NO: 1392376 - DNA, 22 bp, Artificial Sequence
  chemically synthesized
agaaaacttgagattcacatgc

SEQ ID NO: 1392377 - DNA, 22 bp, Artificial Sequence
  chemically synthesized
cattcttctgcatgtgaatctc

SEQ ID NO: 1392378 - DNA, 22 bp, Artificial Sequence
  chemically synthesized
attcttctgcatgtgaatctca

SEQ ID NO: 1392379 - DNA, 22 bp, Artificial Sequence
  chemically synthesized
ttctgcatgtgaatctcaagtt

SEQ ID NO: 1392380 - DNA, 22 bp, Artificial Sequence
  chemically synthesized
ctgcatgtgaatctcaagtttt

SEQ ID NO: 1392381 - DNA, 22 bp, Artificial Sequence
  chemically synthesized
tgcatgtgaatctcaagttttc

SEQ ID NO: 1392382 - DNA, 22 bp, Artificial Sequence
  chemically synthesized
catgtgaatctcaagttttctc

SEQ ID NO: 1392383 - DNA, 22 bp, Artificial Sequence
  chemically synthesized
aacaaacggtgctgagaaaact

SEQ ID NO: 1392384 - DNA, 22 bp, Artificial Sequence
  chemically synthesized
aaacaaacggtgctgagaaaac

SEQ ID NO: 1392385 - DNA, 22 bp, Artificial Sequence
  chemically synthesized
taaacaaacggtgctgagaaaa

SEQ ID NO: 1392386 - DNA, 22 bp, Artificial Sequence
  chemically synthesized
ttaaacaaacggtgctgagaaa

SEQ ID NO: 1392387 - DNA, 22 bp, Artificial Sequence
  chemically synthesized
aagttttctcagcaccgtttgt

SEQ ID NO: 1392388 - DNA, 22 bp, Artificial Sequence
  chemically synthesized
tctcagcaccgtttgtttaaaa

SEQ ID NO: 1392389 - DNA, 22 bp, Artificial Sequence
  chemically synthesized
ctcagcaccgtttgtttaaaag

SEQ ID NO: 1392390 - DNA, 22 bp, Artificial Sequence
  chemically synthesized
tcagcaccgtttgtttaaaaga

SEQ ID NO: 1392391 - DNA, 22 bp, Artificial Sequence
  chemically synthesized
agcaccgtttgtttaaaagatg

SEQ ID NO: 1392392 - DNA, 22 bp, Artificial Sequence
  chemically synthesized
gtttaaaagatgattctttctc

SEQ ID NO: 1392393 - DNA, 22 bp, Artificial Sequence
  chemically synthesized
tttaaaagatgattctttctca

SEQ ID NO: 1392394 - DNA, 22 bp, Artificial Sequence
  chemically synthesized
agaccatgaaaatgagaaagaa

SEQ ID NO: 1392395 - DNA, 22 bp, Artificial Sequence
  chemically synthesized
aaaagatgattctttctcattt

SEQ ID NO: 1392396 - DNA, 22 bp, Artificial Sequence
  chemically synthesized
aaagatgattctttctcatttt

SEQ ID NO: 1392397 - DNA, 22 bp, Artificial Sequence
  chemically synthesized
tttctcattttcatggtcttag

SEQ ID NO: 1392398 - DNA, 22 bp, Artificial Sequence
  chemically synthesized
tctcattttcatggtcttagcc

SEQ ID NO: 1392399 - DNA, 22 bp, Artificial Sequence
  chemically synthesized
ctcattttcatggtcttagcct

SEQ ID NO: 1392400 - DNA, 22 bp, Artificial Sequence
  chemically synthesized
tcattttcatggtcttagcctc

SEQ ID NO: 1392401 - DNA, 22 bp, Artificial Sequence
  chemically synthesized
ataaatgagggagaggctaaga

SEQ ID NO: 1392402 - DNA, 22 bp, Artificial Sequence
  chemically synthesized
attttcatggtcttagcctctc

SEQ ID NO: 1392403 - DNA, 22 bp, Artificial Sequence
  chemically synthesized
tcataaatgagggagaggctaa

SEQ ID NO: 1392404 - DNA, 22 bp, Artificial Sequence
  chemically synthesized
ctctcataaatgagggagaggc

SEQ ID NO: 1392405 - DNA, 22 bp, Artificial Sequence
  chemically synthesized
tcatggtcttagcctctccctc

SEQ ID NO: 1392406 - DNA, 22 bp, Artificial Sequence
  chemically synthesized
cctctcataaatgagggagagg

SEQ ID NO: 1392407 - DNA, 22 bp, Artificial Sequence
  chemically synthesized
catggtcttagcctctccctca

SEQ ID NO: 1392408 - DNA, 22 bp, Artificial Sequence
  chemically synthesized
atggtcttagcctctccctcat

SEQ ID NO: 1392409 - DNA, 22 bp, Artificial Sequence
  chemically synthesized
agcctctccctcatttatgaga

SEQ ID NO: 1392410 - DNA, 22 bp, Artificial Sequence
  chemically synthesized
gcctctccctcatttatgagag

SEQ ID NO: 1392411 - DNA, 22 bp, Artificial Sequence
  chemically synthesized
gcgcagatccttcctctcataa

SEQ ID NO: 1392412 - DNA, 22 bp, Artificial Sequence
  chemically synthesized
tccctcatttatgagaggaagg

SEQ ID NO: 1392413 - DNA, 22 bp, Artificial Sequence
  chemically synthesized
cctcatttatgagaggaaggat

SEQ ID NO: 1392414 - DNA, 22 bp, Artificial Sequence
  chemically synthesized
ccacacctagcgcagatccttc

SEQ ID NO: 1392415 - DNA, 22 bp, Artificial Sequence
  chemically synthesized
atttatgagaggaaggatctgc

SEQ ID NO: 1392416 - DNA, 22 bp, Artificial Sequence
  chemically synthesized
atgagaggaaggatctgcgcta

SEQ ID NO: 1392417 - DNA, 22 bp, Artificial Sequence
  chemically synthesized
agctaccacacctagcgcagat

SEQ ID NO: 1392418 - DNA, 22 bp, Artificial Sequence
  chemically synthesized
tgagaggaaggatctgcgctag

SEQ ID NO: 1392419 - DNA, 22 bp, Artificial Sequence
  chemically synthesized
ctgagctaccacacctagcgca

SEQ ID NO: 1392420 - DNA, 22 bp, Artificial Sequence
  chemically synthesized
tatctcctgagctaccacacct

SEQ ID NO: 1392421 - DNA, 22 bp, Artificial Sequence
  chemically synthesized
tgtatctcctgagctaccacac

SEQ ID NO: 1392422 - DNA, 22 bp, Artificial Sequence
  chemically synthesized
ctgtatctcctgagctaccaca

SEQ ID NO: 1392423 - DNA, 22 bp, Artificial Sequence
  chemically synthesized
cttctgtatctcctgagctacc

SEQ ID NO: 1392424 - DNA, 22 bp, Artificial Sequence
  chemically synthesized
cgctaggtgtggtagctcagga

SEQ ID NO: 1392425 - DNA, 22 bp, Artificial Sequence
  chemically synthesized
ggtgtggtagctcaggagatac

SEQ ID NO: 1392426 - DNA, 22 bp, Artificial Sequence
  chemically synthesized
aagagatgtggctgcttctgta

SEQ ID NO: 1392427 - DNA, 22 bp, Artificial Sequence
  chemically synthesized
aggagatacagaagcagccaca

SEQ ID NO: 1392428 - DNA, 22 bp, Artificial Sequence
  chemically synthesized
gtcatagctgaagagatgtggc

SEQ ID NO: 1392429 - DNA, 22 bp, Artificial Sequence
  chemically synthesized
tcaccacgtctggtcatagctg

SEQ ID NO: 1392430 - DNA, 22 bp, Artificial Sequence
  chemically synthesized
atcaccacgtctggtcatagct

SEQ ID NO: 1392431 - DNA, 22 bp, Artificial Sequence
  chemically synthesized
tggcttatcaccacgtctggtc

SEQ ID NO: 1392432 - DNA, 22 bp, Artificial Sequence
  chemically synthesized
ttcagctatgaccagacgtggt

SEQ ID NO: 1392433 - DNA, 22 bp, Artificial Sequence
  chemically synthesized
ctgtggcttatcaccacgtctg

SEQ ID NO: 1392434 - DNA, 22 bp, Artificial Sequence
  chemically synthesized
cagctatgaccagacgtggtga

SEQ ID NO: 1392435 - DNA, 22 bp, Artificial Sequence
  chemically synthesized
agctatgaccagacgtggtgat

SEQ ID NO: 1392436 - DNA, 22 bp, Artificial Sequence
  chemically synthesized
tgaccagacgtggtgataagcc

SEQ ID NO: 1392437 - DNA, 22 bp, Artificial Sequence
  chemically synthesized
tcagcagaagctgctgtggctt

SEQ ID NO: 1392438 - DNA, 22 bp, Artificial Sequence
  chemically synthesized
atcagcagaagctgctgtggct

SEQ ID NO: 1392439 - DNA, 22 bp, Artificial Sequence
  chemically synthesized
cttatcagcagaagctgctgtg

SEQ ID NO: 1392440 - DNA, 22 bp, Artificial Sequence
  chemically synthesized
acttatcagcagaagctgctgt

SEQ ID NO: 1392441 - DNA, 22 bp, Artificial Sequence
  chemically synthesized
tacttatcagcagaagctgctg

SEQ ID NO: 1392442 - DNA, 22 bp, Artificial Sequence
  chemically synthesized
ttacttatcagcagaagctgct

SEQ ID NO: 1392443 - DNA, 22 bp, Artificial Sequence
  chemically synthesized
tttacttatcagcagaagctgc

SEQ ID NO: 1392444 - DNA, 22 bp, Artificial Sequence
  chemically synthesized
tttttacttatcagcagaagct

SEQ ID NO: 1392445 - DNA, 22 bp, Artificial Sequence
  chemically synthesized
ctttttacttatcagcagaagc

SEQ ID NO: 1392446 - DNA, 22 bp, Artificial Sequence
  chemically synthesized
ttctttttacttatcagcagaa

SEQ ID NO: 1392447 - DNA, 22 bp, Artificial Sequence
  chemically synthesized
cttctttttacttatcagcaga

SEQ ID NO: 1392448 - DNA, 22 bp, Artificial Sequence
  chemically synthesized
ttcttctttttacttatcagca

SEQ ID NO: 1392449 - DNA, 22 bp, Artificial Sequence
  chemically synthesized
tcttcttctttttacttatcag

SEQ ID NO: 1392450 - DNA, 22 bp, Artificial Sequence
  chemically synthesized
cgtgattctcttcttcttttta

SEQ ID NO: 1392451 - DNA, 22 bp, Artificial Sequence
  chemically synthesized
ctgctgataagtaaaaagaaga

SEQ ID NO: 1392452 - DNA, 22 bp, Artificial Sequence
  chemically synthesized
tgctgataagtaaaaagaagaa

SEQ ID NO: 1392453 - DNA, 22 bp, Artificial Sequence
  chemically synthesized
tacgtgattctcttcttctttt

SEQ ID NO: 1392454 - DNA, 22 bp, Artificial Sequence
  chemically synthesized
ctacgtgattctcttcttcttt

SEQ ID NO: 1392455 - DNA, 22 bp, Artificial Sequence
  chemically synthesized
ctgataagtaaaaagaagaaga

SEQ ID NO: 1392456 - DNA, 22 bp, Artificial Sequence
  chemically synthesized
ttctacgtgattctcttcttct

SEQ ID NO: 1392457 - DNA, 22 bp, Artificial Sequence
  chemically synthesized
cttctacgtgattctcttcttc

SEQ ID NO: 1392458 - DNA, 22 bp, Artificial Sequence
  chemically synthesized
ataagtaaaaagaagaagagaa

SEQ ID NO: 1392459 - DNA, 22 bp, Artificial Sequence
  chemically synthesized
gatagacatggccaaaaacagg

SEQ ID NO: 1392460 - DNA, 22 bp, Artificial Sequence
  chemically synthesized
tggatagacatggccaaaaaca

SEQ ID NO: 1392461 - DNA, 22 bp, Artificial Sequence
  chemically synthesized
ctctggatagacatggccaaaa

SEQ ID NO: 1392462 - DNA, 22 bp, Artificial Sequence
  chemically synthesized
actctggatagacatggccaaa

SEQ ID NO: 1392463 - DNA, 22 bp, Artificial Sequence
  chemically synthesized
tactctggatagacatggccaa

SEQ ID NO: 1392464 - DNA, 22 bp, Artificial Sequence
  chemically synthesized
tttttggccatgtctatccaga

SEQ ID NO: 1392465 - DNA, 22 bp, Artificial Sequence
  chemically synthesized
ttggccatgtctatccagagta

SEQ ID NO: 1392466 - DNA, 22 bp, Artificial Sequence
  chemically synthesized
tggccatgtctatccagagtaa

SEQ ID NO: 1392467 - DNA, 22 bp, Artificial Sequence
  chemically synthesized
ggccatgtctatccagagtaaa

SEQ ID NO: 1392468 - DNA, 22 bp, Artificial Sequence
  chemically synthesized
tgtgacagaaactttactctgg

SEQ ID NO: 1392469 - DNA, 22 bp, Artificial Sequence
  chemically synthesized
gccatgtctatccagagtaaag

SEQ ID NO: 1392470 - DNA, 22 bp, Artificial Sequence
  chemically synthesized
tgtgtgacagaaactttactct

SEQ ID NO: 1392471 - DNA, 22 bp, Artificial Sequence
  chemically synthesized
gctctgtgtgacagaaacttta

SEQ ID NO: 1392472 - DNA, 22 bp, Artificial Sequence
  chemically synthesized
tagctctgtgtgacagaaactt

SEQ ID NO: 1392473 - DNA, 22 bp, Artificial Sequence
  chemically synthesized
tctagctctgtgtgacagaaac

SEQ ID NO: 1392474 - DNA, 22 bp, Artificial Sequence
  chemically synthesized
tccagagtaaagtttctgtcac

SEQ ID NO: 1392475 - DNA, 22 bp, Artificial Sequence
  chemically synthesized
tctctagctctgtgtgacagaa

SEQ ID NO: 1392476 - DNA, 22 bp, Artificial Sequence
  chemically synthesized
ctgtcacacagagctagagaga

SEQ ID NO: 1392477 - DNA, 22 bp, Artificial Sequence
  chemically synthesized
tgtcacacagagctagagagag

SEQ ID NO: 1392478 - DNA, 22 bp, Artificial Sequence
  chemically synthesized
tcacacagagctagagagagtg

SEQ ID NO: 1392479 - DNA, 22 bp, Artificial Sequence
  chemically synthesized
agcaacaatccccaccccaacc

SEQ ID NO: 1392480 - DNA, 22 bp, Artificial Sequence
  chemically synthesized
gagcaacaatccccaccccaac

SEQ ID NO: 1392481 - DNA, 22 bp, Artificial Sequence
  chemically synthesized
gagagagtggggttggggtggg

SEQ ID NO: 1392482 - DNA, 22 bp, Artificial Sequence
  chemically synthesized
atgacatttgagcaacaatccc

SEQ ID NO: 1392483 - DNA, 22 bp, Artificial Sequence
  chemically synthesized
gggtggggattgttgctcaaat

SEQ ID NO: 1392484 - DNA, 22 bp, Artificial Sequence
  chemically synthesized
ttgctcaaatgtcattaacttt

SEQ ID NO: 1392485 - DNA, 22 bp, Artificial Sequence
  chemically synthesized
agtcagaacagtgaaagttaat

SEQ ID NO: 1392486 - DNA, 22 bp, Artificial Sequence
  chemically synthesized
ctcaaatgtcattaactttcac

SEQ ID NO: 1392487 - DNA, 22 bp, Artificial Sequence
  chemically synthesized
aaatgtcattaactttcactgt

SEQ ID NO: 1392488 - DNA, 22 bp, Artificial Sequence
  chemically synthesized
caaaatctcagtcagaacagtg

SEQ ID NO: 1392489 - DNA, 22 bp, Artificial Sequence
  chemically synthesized
actttcactgttctgactgaga

SEQ ID NO: 1392490 - DNA, 22 bp, Artificial Sequence
  chemically synthesized
tcactgttctgactgagatttt

SEQ ID NO: 1392491 - DNA, 22 bp, Artificial Sequence
  chemically synthesized
cactgttctgactgagattttg

SEQ ID NO: 1392492 - DNA, 22 bp, Artificial Sequence
  chemically synthesized
actgttctgactgagattttgc

SEQ ID NO: 1392493 - DNA, 22 bp, Artificial Sequence
  chemically synthesized
aaaacaaaaaaacctgcaaaat

SEQ ID NO: 1392494 - DNA, 22 bp, Artificial Sequence
  chemically synthesized
ttctgactgagattttgcaggt

SEQ ID NO: 1392495 - DNA, 22 bp, Artificial Sequence
  chemically synthesized
ttcaaaacaaaaaaacctgcaa

SEQ ID NO: 1392496 - DNA, 22 bp, Artificial Sequence
  chemically synthesized
tgactgagattttgcaggtttt

SEQ ID NO: 1392497 - DNA, 22 bp, Artificial Sequence
  chemically synthesized
attcaaaacaaaaaaacctgca

SEQ ID NO: 1392498 - DNA, 22 bp, Artificial Sequence
  chemically synthesized
actgagattttgcaggtttttt

SEQ ID NO: 1392499 - DNA, 22 bp, Artificial Sequence
  chemically synthesized
agattttgcaggtttttttgtt

SEQ ID NO: 1392500 - DNA, 22 bp, Artificial Sequence
  chemically synthesized
tgcaggtttttttgttttgaat

SEQ ID NO: 1392501 - DNA, 22 bp, Artificial Sequence
  chemically synthesized
gcaggtttttttgttttgaata

SEQ ID NO: 1392502 - DNA, 22 bp, Artificial Sequence
  chemically synthesized
caggtttttttgttttgaataa

SEQ ID NO: 1392503 - DNA, 22 bp, Artificial Sequence
  chemically synthesized
ttttgttttgaataaatatttc

SEQ ID NO: 1392504 - DNA, 22 bp, Artificial Sequence
  chemically synthesized
tttgttttgaataaatatttct

SEQ ID NO: 1392505 - DNA, 22 bp, Artificial Sequence
  chemically synthesized
ttgttttgaataaatatttctc

SEQ ID NO: 1392506 - DNA, 22 bp, Artificial Sequence
  chemically synthesized
tgttttgaataaatatttctcc

SEQ ID NO: 1392507 - DNA, 22 bp, Artificial Sequence
  chemically synthesized
gttttgaataaatatttctcca

SEQ ID NO: 1392508 - DNA, 22 bp, Artificial Sequence
  chemically synthesized
ttttgaataaatatttctccat

SEQ ID NO: 1392509 - DNA, 22 bp, Artificial Sequence
  chemically synthesized
agagcatatagcaaatggagaa

SEQ ID NO: 1392510 - DNA, 22 bp, Artificial Sequence
  chemically synthesized
tgaataaatatttctccatttg

SEQ ID NO: 1392511 - DNA, 22 bp, Artificial Sequence
  chemically synthesized
aagagcatatagcaaatggaga

SEQ ID NO: 1392512 - DNA, 22 bp, Artificial Sequence
  chemically synthesized
gaataaatatttctccatttgc

SEQ ID NO: 1392513 - DNA, 22 bp, Artificial Sequence
  chemically synthesized
aataaatatttctccatttgct

SEQ ID NO: 1392514 - DNA, 22 bp, Artificial Sequence
  chemically synthesized
gaaatggtcttaagagcatata

SEQ ID NO: 1392515 - DNA, 22 bp, Artificial Sequence
  chemically synthesized
ctccatttgctatatgctctta

SEQ ID NO: 1392516 - DNA, 22 bp, Artificial Sequence
  chemically synthesized
tggaaatggtcttaagagcata

SEQ ID NO: 1392517 - DNA, 22 bp, Artificial Sequence
  chemically synthesized
tccatttgctatatgctcttaa

SEQ ID NO: 1392518 - DNA, 22 bp, Artificial Sequence
  chemically synthesized
catttgctatatgctcttaaga

SEQ ID NO: 1392519 - DNA, 22 bp, Artificial Sequence
  chemically synthesized
gctatatgctcttaagaccatt

SEQ ID NO: 1392520 - DNA, 22 bp, Artificial Sequence
  chemically synthesized
ctatatgctcttaagaccattt

SEQ ID NO: 1392521 - DNA, 22 bp, Artificial Sequence
  chemically synthesized
tatgctcttaagaccatttcca

SEQ ID NO: 1392522 - DNA, 22 bp, Artificial Sequence
  chemically synthesized
ttaagaccatttccagagactt

SEQ ID NO: 1392523 - DNA, 22 bp, Artificial Sequence
  chemically synthesized
aagaccatttccagagactttc

SEQ ID NO: 1392524 - DNA, 22 bp, Artificial Sequence
  chemically synthesized
agaccatttccagagactttcc

SEQ ID NO: 1392525 - DNA, 22 bp, Artificial Sequence
  chemically synthesized
taataaaataaccatggaaagt

SEQ ID NO: 1392526 - DNA, 22 bp, Artificial Sequence
  chemically synthesized
ccagagactttccatggttatt

SEQ ID NO: 1392527 - DNA, 22 bp, Artificial Sequence
  chemically synthesized
cagagactttccatggttattt

SEQ ID NO: 1392528 - DNA, 22 bp, Artificial Sequence
  chemically synthesized
gtgaaaattgtaataaaataac

SEQ ID NO: 1392529 - DNA, 22 bp, Artificial Sequence
  chemically synthesized
tccatggttattttattacaat

SEQ ID NO: 1392530 - DNA, 22 bp, Artificial Sequence
  chemically synthesized
taactggtgaaaattgtaataa

SEQ ID NO: 1392531 - DNA, 22 bp, Artificial Sequence
  chemically synthesized
ccatggttattttattacaatt

SEQ ID NO: 1392532 - DNA, 22 bp, Artificial Sequence
  chemically synthesized
catggttattttattacaattt

SEQ ID NO: 1392533 - DNA, 22 bp, Artificial Sequence
  chemically synthesized
ttttattacaattttcaccagt

SEQ ID NO: 1392534 - DNA, 22 bp, Artificial Sequence
  chemically synthesized
tattacaattttcaccagttac

SEQ ID NO: 1392535 - DNA, 22 bp, Artificial Sequence
  chemically synthesized
attacaattttcaccagttaca

SEQ ID NO: 1392536 - DNA, 22 bp, Artificial Sequence
  chemically synthesized
ttacaattttcaccagttacag

SEQ ID NO: 1392537 - DNA, 22 bp, Artificial Sequence
  chemically synthesized
caattttcaccagttacagttg

SEQ ID NO: 1392538 - DNA, 22 bp, Artificial Sequence
  chemically synthesized
tcccgagtaaaacaactgtaac

SEQ ID NO: 1392539 - DNA, 22 bp, Artificial Sequence
  chemically synthesized
tcaccagttacagttgttttac

SEQ ID NO: 1392540 - DNA, 22 bp, Artificial Sequence
  chemically synthesized
caccagttacagttgttttact

SEQ ID NO: 1392541 - DNA, 22 bp, Artificial Sequence
  chemically synthesized
accagttacagttgttttactc

SEQ ID NO: 1392542 - DNA, 22 bp, Artificial Sequence
  chemically synthesized
catggatgctgtcccgagtaaa

SEQ ID NO: 1392543 - DNA, 22 bp, Artificial Sequence
  chemically synthesized
cagttgttttactcgggacagc

SEQ ID NO: 1392544 - DNA, 22 bp, Artificial Sequence
  chemically synthesized
ttttactcgggacagcatccat

SEQ ID NO: 1392545 - DNA, 22 bp, Artificial Sequence
  chemically synthesized
tactcgggacagcatccatgga

SEQ ID NO: 1392546 - DNA, 22 bp, Artificial Sequence
  chemically synthesized
actcgggacagcatccatggag

SEQ ID NO: 1392547 - DNA, 22 bp, Artificial Sequence
  chemically synthesized
ctcgggacagcatccatggagc

SEQ ID NO: 1392548 - DNA, 22 bp, Artificial Sequence
  chemically synthesized
gggacagcatccatggagcccc

SEQ ID NO: 1392549 - DNA, 22 bp, Artificial Sequence
  chemically synthesized
aaatggtagtgtgtagtgtcag

SEQ ID NO: 1392550 - DNA, 22 bp, Artificial Sequence
  chemically synthesized
tgaaatggtagtgtgtagtgtc

SEQ ID NO: 1392551 - DNA, 22 bp, Artificial Sequence
  chemically synthesized
ctgaaatggtagtgtgtagtgt

SEQ ID NO: 1392552 - DNA, 22 bp, Artificial Sequence
  chemically synthesized
acactacacactaccatttcag

SEQ ID NO: 1392553 - DNA, 22 bp, Artificial Sequence
  chemically synthesized
gagagaaacacttctgaaatgg

SEQ ID NO: 1392554 - DNA, 22 bp, Artificial Sequence
  chemically synthesized
ggagagaaacacttctgaaatg

SEQ ID NO: 1392555 - DNA, 22 bp, Artificial Sequence
  chemically synthesized
tggagagaaacacttctgaaat

SEQ ID NO: 1392556 - DNA, 22 bp, Artificial Sequence
  chemically synthesized
cacactaccatttcagaagtgt

SEQ ID NO: 1392557 - DNA, 22 bp, Artificial Sequence
  chemically synthesized
ccatttcagaagtgtttctctc

SEQ ID NO: 1392558 - DNA, 22 bp, Artificial Sequence
  chemically synthesized
cagaagtgtttctctccaaaat

SEQ ID NO: 1392559 - DNA, 22 bp, Artificial Sequence
  chemically synthesized
agaagtgtttctctccaaaatg

SEQ ID NO: 1392560 - DNA, 22 bp, Artificial Sequence
  chemically synthesized
tggcgaaatataaacatgaaca

SEQ ID NO: 1392561 - DNA, 22 bp, Artificial Sequence
  chemically synthesized
ctctccaaaatgttcatgttta

SEQ ID NO: 1392562 - DNA, 22 bp, Artificial Sequence
  chemically synthesized
tctccaaaatgttcatgtttat

SEQ ID NO: 1392563 - DNA, 22 bp, Artificial Sequence
  chemically synthesized
tccaaaatgttcatgtttatat

SEQ ID NO: 1392564 - DNA, 22 bp, Artificial Sequence
  chemically synthesized
caaaatgttcatgtttatattt

SEQ ID NO: 1392565 - DNA, 22 bp, Artificial Sequence
  chemically synthesized
aaaaactatggcgaaatataaa

SEQ ID NO: 1392566 - DNA, 22 bp, Artificial Sequence
  chemically synthesized
actaaaaaactatggcgaaata

SEQ ID NO: 1392567 - DNA, 22 bp, Artificial Sequence
  chemically synthesized
atgtttatatttcgccatagtt

SEQ ID NO: 1392568 - DNA, 22 bp, Artificial Sequence
  chemically synthesized
tgaaatattaactaaaaaacta

SEQ ID NO: 1392569 - DNA, 22 bp, Artificial Sequence
  chemically synthesized
atatttcgccatagttttttag

SEQ ID NO: 1392570 - DNA, 22 bp, Artificial Sequence
  chemically synthesized
gtgaaatattaactaaaaaact

SEQ ID NO: 1392571 - DNA, 22 bp, Artificial Sequence
  chemically synthesized
tatttcgccatagttttttagt

SEQ ID NO: 1392572 - DNA, 22 bp, Artificial Sequence
  chemically synthesized
cgccatagttttttagttaata

SEQ ID NO: 1392573 - DNA, 22 bp, Artificial Sequence
  chemically synthesized
gccatagttttttagttaatat

SEQ ID NO: 1392574 - DNA, 22 bp, Artificial Sequence
  chemically synthesized
caagtttgtgaaatattaacta

SEQ ID NO: 1392575 - DNA, 22 bp, Artificial Sequence
  chemically synthesized
acaagtttgtgaaatattaact

SEQ ID NO: 1392576 - DNA, 22 bp, Artificial Sequence
  chemically synthesized
tacaagtttgtgaaatattaac

SEQ ID NO: 1392577 - DNA, 22 bp, Artificial Sequence
  chemically synthesized
acattttacaagtttgtgaaat

SEQ ID NO: 1392578 - DNA, 22 bp, Artificial Sequence
  chemically synthesized
tttagttaatatttcacaaact

SEQ ID NO: 1392579 - DNA, 22 bp, Artificial Sequence
  chemically synthesized
ttagttaatatttcacaaactt

SEQ ID NO: 1392580 - DNA, 22 bp, Artificial Sequence
  chemically synthesized
tagttaatatttcacaaacttg

SEQ ID NO: 1392581 - DNA, 22 bp, Artificial Sequence
  chemically synthesized
agttaatatttcacaaacttgt

SEQ ID NO: 1392582 - DNA, 22 bp, Artificial Sequence
  chemically synthesized
gttaatatttcacaaacttgta

SEQ ID NO: 1392583 - DNA, 22 bp, Artificial Sequence
  chemically synthesized
atatttcacaaacttgtaaaat

SEQ ID NO: 1392584 - DNA, 22 bp, Artificial Sequence
  chemically synthesized
gggtgaagatactcacatttta

SEQ ID NO: 1392585 - DNA, 22 bp, Artificial Sequence
  chemically synthesized
cacaaacttgtaaaatgtgagt

SEQ ID NO: 1392586 - DNA, 22 bp, Artificial Sequence
  chemically synthesized
acaaacttgtaaaatgtgagta

SEQ ID NO: 1392587 - DNA, 22 bp, Artificial Sequence
  chemically synthesized
aaggttggggtgaagatactca

SEQ ID NO: 1392588 - DNA, 22 bp, Artificial Sequence
  chemically synthesized
gtaaaatgtgagtatcttcacc

SEQ ID NO: 1392589 - DNA, 22 bp, Artificial Sequence
  chemically synthesized
taaaatgtgagtatcttcaccc

SEQ ID NO: 1392590 - DNA, 22 bp, Artificial Sequence
  chemically synthesized
cagtcctgaaggttggggtgaa

SEQ ID NO: 1392591 - DNA, 22 bp, Artificial Sequence
  chemically synthesized
ccactgcagtcctgaaggttgg

SEQ ID NO: 1392592 - DNA, 22 bp, Artificial Sequence
  chemically synthesized
tgccactgcagtcctgaaggtt

SEQ ID NO: 1392593 - DNA, 22 bp, Artificial Sequence
  chemically synthesized
caccccaaccttcaggactgca

SEQ ID NO: 1392594 - DNA, 22 bp, Artificial Sequence
  chemically synthesized
accccaaccttcaggactgcag

SEQ ID NO: 1392595 - DNA, 22 bp, Artificial Sequence
  chemically synthesized
atggcctctgccactgcagtcc

SEQ ID NO: 1392596 - DNA, 22 bp, Artificial Sequence
  chemically synthesized
ttcatggcctctgccactgcag

SEQ ID NO: 1392597 - DNA, 22 bp, Artificial Sequence
  chemically synthesized
ctattcatggcctctgccactg

SEQ ID NO: 1392598 - DNA, 22 bp, Artificial Sequence
  chemically synthesized
caggactgcagtggcagaggcc

SEQ ID NO: 1392599 - DNA, 22 bp, Artificial Sequence
  chemically synthesized
cctcctattcatggcctctgcc

SEQ ID NO: 1392600 - DNA, 22 bp, Artificial Sequence
  chemically synthesized
aggactgcagtggcagaggcca

SEQ ID NO: 1392601 - DNA, 22 bp, Artificial Sequence
  chemically synthesized
tacctcctattcatggcctctg

SEQ ID NO: 1392602 - DNA, 22 bp, Artificial Sequence
  chemically synthesized
ctctacctcctattcatggcct

SEQ ID NO: 1392603 - DNA, 22 bp, Artificial Sequence
  chemically synthesized
cagtggcagaggccatgaatag

SEQ ID NO: 1392604 - DNA, 22 bp, Artificial Sequence
  chemically synthesized
aatcaatctactctacctccta

SEQ ID NO: 1392605 - DNA, 22 bp, Artificial Sequence
  chemically synthesized
aaactaaatcaatctactctac

SEQ ID NO: 1392606 - DNA, 22 bp, Artificial Sequence
  chemically synthesized
aattaaaactaaatcaatctac

SEQ ID NO: 1392607 - DNA, 22 bp, Artificial Sequence
  chemically synthesized
taaattaaaactaaatcaatct

SEQ ID NO: 1392608 - DNA, 22 bp, Artificial Sequence
  chemically synthesized
ctaaattaaaactaaatcaatc

SEQ ID NO: 1392609 - DNA, 22 bp, Artificial Sequence
  chemically synthesized
tctaaattaaaactaaatcaat

SEQ ID NO: 1392610 - DNA, 22 bp, Artificial Sequence
  chemically synthesized
ttctaaattaaaactaaatcaa

SEQ ID NO: 1392611 - DNA, 22 bp, Artificial Sequence
  chemically synthesized
atttttctaaattaaaactaaa

SEQ ID NO: 1392612 - DNA, 22 bp, Artificial Sequence
  chemically synthesized
tatgagttcatttttctaaatt

SEQ ID NO: 1392613 - DNA, 22 bp, Artificial Sequence
  chemically synthesized
atatgagttcatttttctaaat

SEQ ID NO: 1392614 - DNA, 22 bp, Artificial Sequence
  chemically synthesized
atttagttttaatttagaaaaa

SEQ ID NO: 1392615 - DNA, 22 bp, Artificial Sequence
  chemically synthesized
cttatatgagttcatttttcta

SEQ ID NO: 1392616 - DNA, 22 bp, Artificial Sequence
  chemically synthesized
agttttaatttagaaaaatgaa

SEQ ID NO: 1392617 - DNA, 22 bp, Artificial Sequence
  chemically synthesized
gttttaatttagaaaaatgaac

SEQ ID NO: 1392618 - DNA, 22 bp, Artificial Sequence
  chemically synthesized
ttacttatatgagttcattttt

SEQ ID NO: 1392619 - DNA, 22 bp, Artificial Sequence
  chemically synthesized
taatttagaaaaatgaactcat

SEQ ID NO: 1392620 - DNA, 22 bp, Artificial Sequence
  chemically synthesized
aatttagaaaaatgaactcata

SEQ ID NO: 1392621 - DNA, 22 bp, Artificial Sequence
  chemically synthesized
atttagaaaaatgaactcatat

SEQ ID NO: 1392622 - DNA, 22 bp, Artificial Sequence
  chemically synthesized
caattgttacttatatgagttc

SEQ ID NO: 1392623 - DNA, 22 bp, Artificial Sequence
  chemically synthesized
agaaaaatgaactcatataagt

SEQ ID NO: 1392624 - DNA, 22 bp, Artificial Sequence
  chemically synthesized
cctgcaattgttacttatatga

SEQ ID NO: 1392625 - DNA, 22 bp, Artificial Sequence
  chemically synthesized
gaaaaatgaactcatataagta

SEQ ID NO: 1392626 - DNA, 22 bp, Artificial Sequence
  chemically synthesized
acctgcaattgttacttatatg

SEQ ID NO: 1392627 - DNA, 22 bp, Artificial Sequence
  chemically synthesized
tacctgcaattgttacttatat

SEQ ID NO: 1392628 - DNA, 22 bp, Artificial Sequence
  chemically synthesized
ttacctgcaattgttacttata

SEQ ID NO: 1392629 - DNA, 22 bp, Artificial Sequence
  chemically synthesized
atttttacctgcaattgttact

SEQ ID NO: 1392630 - DNA, 22 bp, Artificial Sequence
  chemically synthesized
atataagtaacaattgcaggta

SEQ ID NO: 1392631 - DNA, 22 bp, Artificial Sequence
  chemically synthesized
aatcctaatttttacctgcaat

SEQ ID NO: 1392632 - DNA, 22 bp, Artificial Sequence
  chemically synthesized
caaatgcaaagtctaaatccta

SEQ ID NO: 1392633 - DNA, 22 bp, Artificial Sequence
  chemically synthesized
caggtaaaaattaggatttaga

SEQ ID NO: 1392634 - DNA, 22 bp, Artificial Sequence
  chemically synthesized
ggatttagactttgcatttgta

SEQ ID NO: 1392635 - DNA, 22 bp, Artificial Sequence
  chemically synthesized
agactttgcatttgtaggctct

SEQ ID NO: 1392636 - DNA, 22 bp, Artificial Sequence
  chemically synthesized
gactttgcatttgtaggctctg

SEQ ID NO: 1392637 - DNA, 22 bp, Artificial Sequence
  chemically synthesized
ataaatataagaaaacagagcc

SEQ ID NO: 1392638 - DNA, 22 bp, Artificial Sequence
  chemically synthesized
aataaatataagaaaacagagc

SEQ ID NO: 1392639 - DNA, 22 bp, Artificial Sequence
  chemically synthesized
tgcatttgtaggctctgttttc

SEQ ID NO: 1392640 - DNA, 22 bp, Artificial Sequence
  chemically synthesized
gcatttgtaggctctgttttct

SEQ ID NO: 1392641 - DNA, 22 bp, Artificial Sequence
  chemically synthesized
catttgtaggctctgttttctt

SEQ ID NO: 1392642 - DNA, 22 bp, Artificial Sequence
  chemically synthesized
aacttaataaatataagaaaac

SEQ ID NO: 1392643 - DNA, 22 bp, Artificial Sequence
  chemically synthesized
gtaggctctgttttcttatatt

SEQ ID NO: 1392644 - DNA, 22 bp, Artificial Sequence
  chemically synthesized
taggctctgttttcttatattt

SEQ ID NO: 1392645 - DNA, 22 bp, Artificial Sequence
  chemically synthesized
tgttttcttatatttattaagt

SEQ ID NO: 1392646 - DNA, 22 bp, Artificial Sequence
  chemically synthesized
ttttcttatatttattaagttt

SEQ ID NO: 1392647 - DNA, 22 bp, Artificial Sequence
  chemically synthesized
gtatcaaatatattaaacttaa

SEQ ID NO: 1392648 - DNA, 22 bp, Artificial Sequence
  chemically synthesized
tcttatatttattaagtttaat

SEQ ID NO: 1392649 - DNA, 22 bp, Artificial Sequence
  chemically synthesized
cttatatttattaagtttaata

SEQ ID NO: 1392650 - DNA, 22 bp, Artificial Sequence
  chemically synthesized
ttatatttattaagtttaatat

SEQ ID NO: 1392651 - DNA, 22 bp, Artificial Sequence
  chemically synthesized
cctagtatcaaatatattaaac

SEQ ID NO: 1392652 - DNA, 22 bp, Artificial Sequence
  chemically synthesized
atatttattaagtttaatatat

SEQ ID NO: 1392653 - DNA, 22 bp, Artificial Sequence
  chemically synthesized
tatttattaagtttaatatatt

SEQ ID NO: 1392654 - DNA, 22 bp, Artificial Sequence
  chemically synthesized
ctacctagtatcaaatatatta

SEQ ID NO: 1392655 - DNA, 22 bp, Artificial Sequence
  chemically synthesized
actacctagtatcaaatatatt

SEQ ID NO: 1392656 - DNA, 22 bp, Artificial Sequence
  chemically synthesized
tactacctagtatcaaatatat

SEQ ID NO: 1392657 - DNA, 22 bp, Artificial Sequence
  chemically synthesized
attaagtttaatatatttgata

SEQ ID NO: 1392658 - DNA, 22 bp, Artificial Sequence
  chemically synthesized
ttaagtttaatatatttgatac

SEQ ID NO: 1392659 - DNA, 22 bp, Artificial Sequence
  chemically synthesized
agtttaatatatttgatactag

SEQ ID NO: 1392660 - DNA, 22 bp, Artificial Sequence
  chemically synthesized
aatatatttgatactaggtagt

SEQ ID NO: 1392661 - DNA, 22 bp, Artificial Sequence
  chemically synthesized
atatatttgatactaggtagta

SEQ ID NO: 1392662 - DNA, 22 bp, Artificial Sequence
  chemically synthesized
ggtagtaaacattttactacct

SEQ ID NO: 1392663 - DNA, 22 bp, Artificial Sequence
  chemically synthesized
cggtagtaaacattttactacc

SEQ ID NO: 1392664 - DNA, 22 bp, Artificial Sequence
  chemically synthesized
tcggtagtaaacattttactac

SEQ ID NO: 1392665 - DNA, 22 bp, Artificial Sequence
  chemically synthesized
ttcggtagtaaacattttacta

SEQ ID NO: 1392666 - DNA, 22 bp, Artificial Sequence
  chemically synthesized
tttcggtagtaaacattttact

SEQ ID NO: 1392667 - DNA, 22 bp, Artificial Sequence
  chemically synthesized
ttttcggtagtaaacattttac

SEQ ID NO: 1392668 - DNA, 22 bp, Artificial Sequence
  chemically synthesized
gatactaggtagtaaaatgttt

SEQ ID NO: 1392669 - DNA, 22 bp, Artificial Sequence
  chemically synthesized
tttttcggtagtaaacatttta

SEQ ID NO: 1392670 - DNA, 22 bp, Artificial Sequence
  chemically synthesized
atactaggtagtaaaatgttta

SEQ ID NO: 1392671 - DNA, 22 bp, Artificial Sequence
  chemically synthesized
ttttttcggtagtaaacatttt

SEQ ID NO: 1392672 - DNA, 22 bp, Artificial Sequence
  chemically synthesized
tttttttcggtagtaaacattt

SEQ ID NO: 1392673 - DNA, 22 bp, Artificial Sequence
  chemically synthesized
ggtagtaaaatgtttactaccg

SEQ ID NO: 1392674 - DNA, 22 bp, Artificial Sequence
  chemically synthesized
gcaaaagttttttttttcggta

SEQ ID NO: 1392675 - DNA, 22 bp, Artificial Sequence
  chemically synthesized
ggcaaaagttttttttttcggt

SEQ ID NO: 1392676 - DNA, 22 bp, Artificial Sequence
  chemically synthesized
tggcaaaagttttttttttcgg

SEQ ID NO: 1392677 - DNA, 22 bp, Artificial Sequence
  chemically synthesized
actaccgaaaaaaaaaactttt

SEQ ID NO: 1392678 - DNA, 22 bp, Artificial Sequence
  chemically synthesized
acacattttggcaaaagttttt

SEQ ID NO: 1392679 - DNA, 22 bp, Artificial Sequence
  chemically synthesized
ctaccgaaaaaaaaaacttttg

SEQ ID NO: 1392680 - DNA, 22 bp, Artificial Sequence
  chemically synthesized
gacacattttggcaaaagtttt

SEQ ID NO: 1392681 - DNA, 22 bp, Artificial Sequence
  chemically synthesized
ccgaaaaaaaaaacttttgcca

SEQ ID NO: 1392682 - DNA, 22 bp, Artificial Sequence
  chemically synthesized
taaaataaaaaatttgacacat

SEQ ID NO: 1392683 - DNA, 22 bp, Artificial Sequence
  chemically synthesized
ctataaaataaaaaatttgaca

SEQ ID NO: 1392684 - DNA, 22 bp, Artificial Sequence
  chemically synthesized
ttgccaaaatgtgtcaaatttt

SEQ ID NO: 1392685 - DNA, 22 bp, Artificial Sequence
  chemically synthesized
gctataaaataaaaaatttgac

SEQ ID NO: 1392686 - DNA, 22 bp, Artificial Sequence
  chemically synthesized
tgccaaaatgtgtcaaattttt

SEQ ID NO: 1392687 - DNA, 22 bp, Artificial Sequence
  chemically synthesized
gccaaaatgtgtcaaatttttt

SEQ ID NO: 1392688 - DNA, 22 bp, Artificial Sequence
  chemically synthesized
ccaaaatgtgtcaaatttttta

SEQ ID NO: 1392689 - DNA, 22 bp, Artificial Sequence
  chemically synthesized
gaagagtatttgctataaaata

SEQ ID NO: 1392690 - DNA, 22 bp, Artificial Sequence
  chemically synthesized
actagaagagtatttgctataa

SEQ ID NO: 1392691 - DNA, 22 bp, Artificial Sequence
  chemically synthesized
tttattttatagcaaatactct

SEQ ID NO: 1392692 - DNA, 22 bp, Artificial Sequence
  chemically synthesized
ttattttatagcaaatactctt

SEQ ID NO: 1392693 - DNA, 22 bp, Artificial Sequence
  chemically synthesized
tattttatagcaaatactcttc

SEQ ID NO: 1392694 - DNA, 22 bp, Artificial Sequence
  chemically synthesized
attttatagcaaatactcttct

SEQ ID NO: 1392695 - DNA, 22 bp, Artificial Sequence
  chemically synthesized
ttttatagcaaatactcttcta

SEQ ID NO: 1392696 - DNA, 22 bp, Artificial Sequence
  chemically synthesized
tatagcaaatactcttctagtt

SEQ ID NO: 1392697 - DNA, 22 bp, Artificial Sequence
  chemically synthesized
atagcaaatactcttctagtta

SEQ ID NO: 1392698 - DNA, 22 bp, Artificial Sequence
  chemically synthesized
tagcaaatactcttctagttaa

SEQ ID NO: 1392699 - DNA, 22 bp, Artificial Sequence
  chemically synthesized
aagataaaatatatgttaacta

SEQ ID NO: 1392700 - DNA, 22 bp, Artificial Sequence
  chemically synthesized
ggcactgaagataaaatatatg

SEQ ID NO: 1392701 - DNA, 22 bp, Artificial Sequence
  chemically synthesized
ttctagttaacatatattttat

SEQ ID NO: 1392702 - DNA, 22 bp, Artificial Sequence
  chemically synthesized
ctagttaacatatattttatct

SEQ ID NO: 1392703 - DNA, 22 bp, Artificial Sequence
  chemically synthesized
tagttaacatatattttatctt

SEQ ID NO: 1392704 - DNA, 22 bp, Artificial Sequence
  chemically synthesized
gttaacatatattttatcttca

SEQ ID NO: 1392705 - DNA, 22 bp, Artificial Sequence
  chemically synthesized
aaataactgggcactgaagata

SEQ ID NO: 1392706 - DNA, 22 bp, Artificial Sequence
  chemically synthesized
acatatattttatcttcagtgc

SEQ ID NO: 1392707 - DNA, 22 bp, Artificial Sequence
  chemically synthesized
atgaagctgaaataactgggca

SEQ ID NO: 1392708 - DNA, 22 bp, Artificial Sequence
  chemically synthesized
aatgaagctgaaataactgggc

SEQ ID NO: 1392709 - DNA, 22 bp, Artificial Sequence
  chemically synthesized
tatcttcagtgcccagttattt

SEQ ID NO: 1392710 - DNA, 22 bp, Artificial Sequence
  chemically synthesized
ttaatgaagctgaaataactgg

SEQ ID NO: 1392711 - DNA, 22 bp, Artificial Sequence
  chemically synthesized
atcttcagtgcccagttatttc

SEQ ID NO: 1392712 - DNA, 22 bp, Artificial Sequence
  chemically synthesized
tcttcagtgcccagttatttca

SEQ ID NO: 1392713 - DNA, 22 bp, Artificial Sequence
  chemically synthesized
tcttaatgaagctgaaataact

SEQ ID NO: 1392714 - DNA, 22 bp, Artificial Sequence
  chemically synthesized
ctcttaatgaagctgaaataac

SEQ ID NO: 1392715 - DNA, 22 bp, Artificial Sequence
  chemically synthesized
tctcttaatgaagctgaaataa

SEQ ID NO: 1392716 - DNA, 22 bp, Artificial Sequence
  chemically synthesized
ttctcttaatgaagctgaaata

SEQ ID NO: 1392717 - DNA, 22 bp, Artificial Sequence
  chemically synthesized
cagtgcccagttatttcagctt

SEQ ID NO: 1392718 - DNA, 22 bp, Artificial Sequence
  chemically synthesized
tttctcttaatgaagctgaaat

SEQ ID NO: 1392719 - DNA, 22 bp, Artificial Sequence
  chemically synthesized
agtgcccagttatttcagcttc

SEQ ID NO: 1392720 - DNA, 22 bp, Artificial Sequence
  chemically synthesized
ttttctcttaatgaagctgaaa

SEQ ID NO: 1392721 - DNA, 22 bp, Artificial Sequence
  chemically synthesized
tttttctcttaatgaagctgaa

SEQ ID NO: 1392722 - DNA, 22 bp, Artificial Sequence
  chemically synthesized
ttttttctcttaatgaagctga

SEQ ID NO: 1392723 - DNA, 22 bp, Artificial Sequence
  chemically synthesized
tttttttctcttaatgaagctg

SEQ ID NO: 1392724 - DNA, 22 bp, Artificial Sequence
  chemically synthesized
ttttttttctcttaatgaagct

SEQ ID NO: 1392725 - DNA, 22 bp, Artificial Sequence
  chemically synthesized
ccttttttttttctcttaatga

SEQ ID NO: 1392726 - DNA, 22 bp, Artificial Sequence
  chemically synthesized
tttcagcttcattaagagaaaa

SEQ ID NO: 1392727 - DNA, 22 bp, Artificial Sequence
  chemically synthesized
attcccttttttttttctctta

SEQ ID NO: 1392728 - DNA, 22 bp, Artificial Sequence
  chemically synthesized
gattcccttttttttttctctt

SEQ ID NO: 1392729 - DNA, 22 bp, Artificial Sequence
  chemically synthesized
tgattcccttttttttttctct

SEQ ID NO: 1392730 - DNA, 22 bp, Artificial Sequence
  chemically synthesized
cagcttcattaagagaaaaaaa

SEQ ID NO: 1392731 - DNA, 22 bp, Artificial Sequence
  chemically synthesized
agcttcattaagagaaaaaaaa

SEQ ID NO: 1392732 - DNA, 22 bp, Artificial Sequence
  chemically synthesized
tttgattcccttttttttttct

SEQ ID NO: 1392733 - DNA, 22 bp, Artificial Sequence
  chemically synthesized
ctctttgattcccttttttttt

SEQ ID NO: 1392734 - DNA, 22 bp, Artificial Sequence
  chemically synthesized
cattaagagaaaaaaaaaaggg

SEQ ID NO: 1392735 - DNA, 22 bp, Artificial Sequence
  chemically synthesized
attaagagaaaaaaaaaaggga

SEQ ID NO: 1392736 - DNA, 22 bp, Artificial Sequence
  chemically synthesized
tattactctttgattccctttt

SEQ ID NO: 1392737 - DNA, 22 bp, Artificial Sequence
  chemically synthesized
agagaaaaaaaaaagggaatca

SEQ ID NO: 1392738 - DNA, 22 bp, Artificial Sequence
  chemically synthesized
aaatcaaaaaggcactatatta

SEQ ID NO: 1392739 - DNA, 22 bp, Artificial Sequence
  chemically synthesized
aaaatcaaaaaggcactatatt

SEQ ID NO: 1392740 - DNA, 22 bp, Artificial Sequence
  chemically synthesized
gtcttaaaatcaaaaaggcact

SEQ ID NO: 1392741 - DNA, 22 bp, Artificial Sequence
  chemically synthesized
ccaagggtaataagagctagtc

SEQ ID NO: 1392742 - DNA, 22 bp, Artificial Sequence
  chemically synthesized
tttgattttaagactagctctt

SEQ ID NO: 1392743 - DNA, 22 bp, Artificial Sequence
  chemically synthesized
ttgattttaagactagctctta

SEQ ID NO: 1392744 - DNA, 22 bp, Artificial Sequence
  chemically synthesized
tgattttaagactagctcttat

SEQ ID NO: 1392745 - DNA, 22 bp, Artificial Sequence
  chemically synthesized
ttgccaagggtaataagagcta

SEQ ID NO: 1392746 - DNA, 22 bp, Artificial Sequence
  chemically synthesized
gattttaagactagctcttatt

SEQ ID NO: 1392747 - DNA, 22 bp, Artificial Sequence
  chemically synthesized
attttaagactagctcttatta

SEQ ID NO: 1392748 - DNA, 22 bp, Artificial Sequence
  chemically synthesized
taagactagctcttattaccct

SEQ ID NO: 1392749 - DNA, 22 bp, Artificial Sequence
  chemically synthesized
aagactagctcttattaccctt

SEQ ID NO: 1392750 - DNA, 22 bp, Artificial Sequence
  chemically synthesized
taatctattgccaagggtaata

SEQ ID NO: 1392751 - DNA, 22 bp, Artificial Sequence
  chemically synthesized
agactagctcttattacccttg

SEQ ID NO: 1392752 - DNA, 22 bp, Artificial Sequence
  chemically synthesized
tataatctattgccaagggtaa

SEQ ID NO: 1392753 - DNA, 22 bp, Artificial Sequence
  chemically synthesized
ctataatctattgccaagggta

SEQ ID NO: 1392754 - DNA, 22 bp, Artificial Sequence
  chemically synthesized
gctcttattacccttggcaata

SEQ ID NO: 1392755 - DNA, 22 bp, Artificial Sequence
  chemically synthesized
ttattacccttggcaatagatt

SEQ ID NO: 1392756 - DNA, 22 bp, Artificial Sequence
  chemically synthesized
tatgatttctataatctattgc

SEQ ID NO: 1392757 - DNA, 22 bp, Artificial Sequence
  chemically synthesized
gtatgatttctataatctattg

SEQ ID NO: 1392758 - DNA, 22 bp, Artificial Sequence
  chemically synthesized
attacccttggcaatagattat

SEQ ID NO: 1392759 - DNA, 22 bp, Artificial Sequence
  chemically synthesized
ttacccttggcaatagattata

SEQ ID NO: 1392760 - DNA, 22 bp, Artificial Sequence
  chemically synthesized
cttgtatgatttctataatcta

SEQ ID NO: 1392761 - DNA, 22 bp, Artificial Sequence
  chemically synthesized
cccttggcaatagattatagaa

SEQ ID NO: 1392762 - DNA, 22 bp, Artificial Sequence
  chemically synthesized
ggcaatagattatagaaatcat

SEQ ID NO: 1392763 - DNA, 22 bp, Artificial Sequence
  chemically synthesized
gcaatagattatagaaatcata

SEQ ID NO: 1392764 - DNA, 22 bp, Artificial Sequence
  chemically synthesized
tatatactgcttgtatgatttc

SEQ ID NO: 1392765 - DNA, 22 bp, Artificial Sequence
  chemically synthesized
aaattgtatatactgcttgtat

SEQ ID NO: 1392766 - DNA, 22 bp, Artificial Sequence
  chemically synthesized
gaaattgtatatactgcttgta

SEQ ID NO: 1392767 - DNA, 22 bp, Artificial Sequence
  chemically synthesized
tgaaattgtatatactgcttgt

SEQ ID NO: 1392768 - DNA, 22 bp, Artificial Sequence
  chemically synthesized
tagaaatcatacaagcagtata

SEQ ID NO: 1392769 - DNA, 22 bp, Artificial Sequence
  chemically synthesized
tgtgtgactttgaaattgtata

SEQ ID NO: 1392770 - DNA, 22 bp, Artificial Sequence
  chemically synthesized
gtgtgtgactttgaaattgtat

SEQ ID NO: 1392771 - DNA, 22 bp, Artificial Sequence
  chemically synthesized
tgtgtgtgactttgaaattgta

SEQ ID NO: 1392772 - DNA, 22 bp, Artificial Sequence
  chemically synthesized
ttgtgtgtgactttgaaattgt

SEQ ID NO: 1392773 - DNA, 22 bp, Artificial Sequence
  chemically synthesized
aagaatatacttttgtgtgtga

SEQ ID NO: 1392774 - DNA, 22 bp, Artificial Sequence
  chemically synthesized
caaagtcacacacaaaagtata

SEQ ID NO: 1392775 - DNA, 22 bp, Artificial Sequence
  chemically synthesized
aaagtcacacacaaaagtatat

SEQ ID NO: 1392776 - DNA, 22 bp, Artificial Sequence
  chemically synthesized
aataattcaagaatatactttt

SEQ ID NO: 1392777 - DNA, 22 bp, Artificial Sequence
  chemically synthesized
aaataattcaagaatatacttt

SEQ ID NO: 1392778 - DNA, 22 bp, Artificial Sequence
  chemically synthesized
taaataattcaagaatatactt

SEQ ID NO: 1392779 - DNA, 22 bp, Artificial Sequence
  chemically synthesized
ttaaataattcaagaatatact

SEQ ID NO: 1392780 - DNA, 22 bp, Artificial Sequence
  chemically synthesized
tttaaataattcaagaatatac

SEQ ID NO: 1392781 - DNA, 22 bp, Artificial Sequence
  chemically synthesized
aaactttttaaataattcaaga

SEQ ID NO: 1392782 - DNA, 22 bp, Artificial Sequence
  chemically synthesized
tgagttgaaactttttaaataa

SEQ ID NO: 1392783 - DNA, 22 bp, Artificial Sequence
  chemically synthesized
gtgagttgaaactttttaaata

SEQ ID NO: 1392784 - DNA, 22 bp, Artificial Sequence
  chemically synthesized
ttgaattatttaaaaagtttca

SEQ ID NO: 1392785 - DNA, 22 bp, Artificial Sequence
  chemically synthesized
gaattatttaaaaagtttcaac

SEQ ID NO: 1392786 - DNA, 22 bp, Artificial Sequence
  chemically synthesized
aattatttaaaaagtttcaact

SEQ ID NO: 1392787 - DNA, 22 bp, Artificial Sequence
  chemically synthesized
cagtgaatatttgtgagttgaa

SEQ ID NO: 1392788 - DNA, 22 bp, Artificial Sequence
  chemically synthesized
tttaaaaagtttcaactcacaa

SEQ ID NO: 1392789 - DNA, 22 bp, Artificial Sequence
  chemically synthesized
tacagtgaatatttgtgagttg

SEQ ID NO: 1392790 - DNA, 22 bp, Artificial Sequence
  chemically synthesized
ctacagtgaatatttgtgagtt

SEQ ID NO: 1392791 - DNA, 22 bp, Artificial Sequence
  chemically synthesized
aaaaagtttcaactcacaaata

SEQ ID NO: 1392792 - DNA, 22 bp, Artificial Sequence
  chemically synthesized
aaaagtttcaactcacaaatat

SEQ ID NO: 1392793 - DNA, 22 bp, Artificial Sequence
  chemically synthesized
tatgtttctacagtgaatattt

SEQ ID NO: 1392794 - DNA, 22 bp, Artificial Sequence
  chemically synthesized
gtatgtttctacagtgaatatt

SEQ ID NO: 1392795 - DNA, 22 bp, Artificial Sequence
  chemically synthesized
tgtatgtttctacagtgaatat

SEQ ID NO: 1392796 - DNA, 22 bp, Artificial Sequence
  chemically synthesized
caactcacaaatattcactgta

SEQ ID NO: 1392797 - DNA, 22 bp, Artificial Sequence
  chemically synthesized
aactcacaaatattcactgtag

SEQ ID NO: 1392798 - DNA, 22 bp, Artificial Sequence
  chemically synthesized
gatgttttgtatgtttctacag

SEQ ID NO: 1392799 - DNA, 22 bp, Artificial Sequence
  chemically synthesized
acaaatattcactgtagaaaca

SEQ ID NO: 1392800 - DNA, 22 bp, Artificial Sequence
  chemically synthesized
tcgatgttttgtatgtttctac

SEQ ID NO: 1392801 - DNA, 22 bp, Artificial Sequence
  chemically synthesized
aattctcgatgttttgtatgtt

SEQ ID NO: 1392802 - DNA, 22 bp, Artificial Sequence
  chemically synthesized
aaattctcgatgttttgtatgt

SEQ ID NO: 1392803 - DNA, 22 bp, Artificial Sequence
  chemically synthesized
taaattctcgatgttttgtatg

SEQ ID NO: 1392804 - DNA, 22 bp, Artificial Sequence
  chemically synthesized
actgtagaaacatacaaaacat

SEQ ID NO: 1392805 - DNA, 22 bp, Artificial Sequence
  chemically synthesized
tagaaacatacaaaacatcgag

SEQ ID NO: 1392806 - DNA, 22 bp, Artificial Sequence
  chemically synthesized
atatgtcctttaaattctcgat

SEQ ID NO: 1392807 - DNA, 22 bp, Artificial Sequence
  chemically synthesized
catatgtcctttaaattctcga

SEQ ID NO: 1392808 - DNA, 22 bp, Artificial Sequence
  chemically synthesized
tcatatgtcctttaaattctcg

SEQ ID NO: 1392809 - DNA, 22 bp, Artificial Sequence
  chemically synthesized
ttttcatatgtcctttaaattc

SEQ ID NO: 1392810 - DNA, 22 bp, Artificial Sequence
  chemically synthesized
gttgttttcatatgtcctttaa

SEQ ID NO: 1392811 - DNA, 22 bp, Artificial Sequence
  chemically synthesized
tggttgttttcatatgtccttt

SEQ ID NO: 1392812 - DNA, 22 bp, Artificial Sequence
  chemically synthesized
ctggttgttttcatatgtcctt

SEQ ID NO: 1392813 - DNA, 22 bp, Artificial Sequence
  chemically synthesized
tctggttgttttcatatgtcct

SEQ ID NO: 1392814 - DNA, 22 bp, Artificial Sequence
  chemically synthesized
ttctggttgttttcatatgtcc

SEQ ID NO: 1392815 - DNA, 22 bp, Artificial Sequence
  chemically synthesized
ttttctggttgttttcatatgt

SEQ ID NO: 1392816 - DNA, 22 bp, Artificial Sequence
  chemically synthesized
actcttttctggttgttttcat

SEQ ID NO: 1392817 - DNA, 22 bp, Artificial Sequence
  chemically synthesized
aactcttttctggttgttttca

SEQ ID NO: 1392818 - DNA, 22 bp, Artificial Sequence
  chemically synthesized
taactcttttctggttgttttc

SEQ ID NO: 1392819 - DNA, 22 bp, Artificial Sequence
  chemically synthesized
aaaggacatatgaaaacaacca

SEQ ID NO: 1392820 - DNA, 22 bp, Artificial Sequence
  chemically synthesized
aaggacatatgaaaacaaccag

SEQ ID NO: 1392821 - DNA, 22 bp, Artificial Sequence
  chemically synthesized
aacgtaatccatgctttaactc

SEQ ID NO: 1392822 - DNA, 22 bp, Artificial Sequence
  chemically synthesized
taaaactaaacgtaatccatgc

SEQ ID NO: 1392823 - DNA, 22 bp, Artificial Sequence
  chemically synthesized
attgtaaaactaaacgtaatcc

SEQ ID NO: 1392824 - DNA, 22 bp, Artificial Sequence
  chemically synthesized
cattgtaaaactaaacgtaatc

SEQ ID NO: 1392825 - DNA, 22 bp, Artificial Sequence
  chemically synthesized
tcattgtaaaactaaacgtaat

SEQ ID NO: 1392826 - DNA, 22 bp, Artificial Sequence
  chemically synthesized
ttcattgtaaaactaaacgtaa

SEQ ID NO: 1392827 - DNA, 22 bp, Artificial Sequence
  chemically synthesized
aagcatggattacgtttagttt

SEQ ID NO: 1392828 - DNA, 22 bp, Artificial Sequence
  chemically synthesized
cttttcattgtaaaactaaacg

SEQ ID NO: 1392829 - DNA, 22 bp, Artificial Sequence
  chemically synthesized
ttgcttttcattgtaaaactaa

SEQ ID NO: 1392830 - DNA, 22 bp, Artificial Sequence
  chemically synthesized
tgttgcttttcattgtaaaact

SEQ ID NO: 1392831 - DNA, 22 bp, Artificial Sequence
  chemically synthesized
cgtttagttttacaatgaaaag

SEQ ID NO: 1392832 - DNA, 22 bp, Artificial Sequence
  chemically synthesized
aaagtctctgttgcttttcatt

SEQ ID NO: 1392833 - DNA, 22 bp, Artificial Sequence
  chemically synthesized
caaagtctctgttgcttttcat

SEQ ID NO: 1392834 - DNA, 22 bp, Artificial Sequence
  chemically synthesized
agttttacaatgaaaagcaaca

SEQ ID NO: 1392835 - DNA, 22 bp, Artificial Sequence
  chemically synthesized
gttttacaatgaaaagcaacag

SEQ ID NO: 1392836 - DNA, 22 bp, Artificial Sequence
  chemically synthesized
atttcaaagtctctgttgcttt

SEQ ID NO: 1392837 - DNA, 22 bp, Artificial Sequence
  chemically synthesized
aatttcaaagtctctgttgctt

SEQ ID NO: 1392838 - DNA, 22 bp, Artificial Sequence
  chemically synthesized
taatttcaaagtctctgttgct

SEQ ID NO: 1392839 - DNA, 22 bp, Artificial Sequence
  chemically synthesized
tacaatgaaaagcaacagagac

SEQ ID NO: 1392840 - DNA, 22 bp, Artificial Sequence
  chemically synthesized
acaatgaaaagcaacagagact

SEQ ID NO: 1392841 - DNA, 22 bp, Artificial Sequence
  chemically synthesized
caatgaaaagcaacagagactt

SEQ ID NO: 1392842 - DNA, 22 bp, Artificial Sequence
  chemically synthesized
acaatccatagtaaatctttaa

SEQ ID NO: 1392843 - DNA, 22 bp, Artificial Sequence
  chemically synthesized
cacaatccatagtaaatcttta

SEQ ID NO: 1392844 - DNA, 22 bp, Artificial Sequence
  chemically synthesized
tcacaatccatagtaaatcttt

SEQ ID NO: 1392845 - DNA, 22 bp, Artificial Sequence
  chemically synthesized
tgaaattaaagatttactatgg

SEQ ID NO: 1392846 - DNA, 22 bp, Artificial Sequence
  chemically synthesized
agctttcacaatccatagtaaa

SEQ ID NO: 1392847 - DNA, 22 bp, Artificial Sequence
  chemically synthesized
gaaattaaagatttactatgga

SEQ ID NO: 1392848 - DNA, 22 bp, Artificial Sequence
  chemically synthesized
aaattaaagatttactatggat

SEQ ID NO: 1392849 - DNA, 22 bp, Artificial Sequence
  chemically synthesized
gcattcagctttcacaatccat

SEQ ID NO: 1392850 - DNA, 22 bp, Artificial Sequence
  chemically synthesized
agcattcagctttcacaatcca

SEQ ID NO: 1392851 - DNA, 22 bp, Artificial Sequence
  chemically synthesized
aagatttactatggattgtgaa

SEQ ID NO: 1392852 - DNA, 22 bp, Artificial Sequence
  chemically synthesized
agatttagcattcagctttcac

SEQ ID NO: 1392853 - DNA, 22 bp, Artificial Sequence
  chemically synthesized
aagatttagcattcagctttca

SEQ ID NO: 1392854 - DNA, 22 bp, Artificial Sequence
  chemically synthesized
actatggattgtgaaagctgaa

SEQ ID NO: 1392855 - DNA, 22 bp, Artificial Sequence
  chemically synthesized
ctatggattgtgaaagctgaat

SEQ ID NO: 1392856 - DNA, 22 bp, Artificial Sequence
  chemically synthesized
cttaagatttagcattcagctt

SEQ ID NO: 1392857 - DNA, 22 bp, Artificial Sequence
  chemically synthesized
tggattgtgaaagctgaatgct

SEQ ID NO: 1392858 - DNA, 22 bp, Artificial Sequence
  chemically synthesized
aaaattccttaagatttagcat

SEQ ID NO: 1392859 - DNA, 22 bp, Artificial Sequence
  chemically synthesized
tgaaagctgaatgctaaatctt

SEQ ID NO: 1392860 - DNA, 22 bp, Artificial Sequence
  chemically synthesized
aatgctaaatcttaaggaattt

SEQ ID NO: 1392861 - DNA, 22 bp, Artificial Sequence
  chemically synthesized
atagtatgccctcaaaattcct

SEQ ID NO: 1392862 - DNA, 22 bp, Artificial Sequence
  chemically synthesized
aatagtatgccctcaaaattcc

SEQ ID NO: 1392863 - DNA, 22 bp, Artificial Sequence
  chemically synthesized
aatcttaaggaattttgagggc

SEQ ID NO: 1392864 - DNA, 22 bp, Artificial Sequence
  chemically synthesized
tgtttaatagtatgccctcaaa

SEQ ID NO: 1392865 - DNA, 22 bp, Artificial Sequence
  chemically synthesized
aaggaattttgagggcatacta

SEQ ID NO: 1392866 - DNA, 22 bp, Artificial Sequence
  chemically synthesized
aggaattttgagggcatactat

SEQ ID NO: 1392867 - DNA, 22 bp, Artificial Sequence
  chemically synthesized
acaagggctatgtttaatagta

SEQ ID NO: 1392868 - DNA, 22 bp, Artificial Sequence
  chemically synthesized
aacaagggctatgtttaatagt

SEQ ID NO: 1392869 - DNA, 22 bp, Artificial Sequence
  chemically synthesized
taacaagggctatgtttaatag

SEQ ID NO: 1392870 - DNA, 22 bp, Artificial Sequence
  chemically synthesized
tgagggcatactattaaacata

SEQ ID NO: 1392871 - DNA, 22 bp, Artificial Sequence
  chemically synthesized
gagggcatactattaaacatag

SEQ ID NO: 1392872 - DNA, 22 bp, Artificial Sequence
  chemically synthesized
agggcatactattaaacatagc

SEQ ID NO: 1392873 - DNA, 22 bp, Artificial Sequence
  chemically synthesized
attttaacaagggctatgttta

SEQ ID NO: 1392874 - DNA, 22 bp, Artificial Sequence
  chemically synthesized
aattttaacaagggctatgttt

SEQ ID NO: 1392875 - DNA, 22 bp, Artificial Sequence
  chemically synthesized
tttaattttaacaagggctatg

SEQ ID NO: 1392876 - DNA, 22 bp, Artificial Sequence
  chemically synthesized
atttaattttaacaagggctat

SEQ ID NO: 1392877 - DNA, 22 bp, Artificial Sequence
  chemically synthesized
ttaaacatagcccttgttaaaa

SEQ ID NO: 1392878 - DNA, 22 bp, Artificial Sequence
  chemically synthesized
aacatagcccttgttaaaatta

SEQ ID NO: 1392879 - DNA, 22 bp, Artificial Sequence
  chemically synthesized
atcataagtttatttaatttta

SEQ ID NO: 1392880 - DNA, 22 bp, Artificial Sequence
  chemically synthesized
aatcataagtttatttaatttt

SEQ ID NO: 1392881 - DNA, 22 bp, Artificial Sequence
  chemically synthesized
tttaatcataagtttatttaat

SEQ ID NO: 1392882 - DNA, 22 bp, Artificial Sequence
  chemically synthesized
atttaatcataagtttatttaa

SEQ ID NO: 1392883 - DNA, 22 bp, Artificial Sequence
  chemically synthesized
gttaaaattaaataaacttatg

SEQ ID NO: 1392884 - DNA, 22 bp, Artificial Sequence
  chemically synthesized
ttaaaattaaataaacttatga

SEQ ID NO: 1392885 - DNA, 22 bp, Artificial Sequence
  chemically synthesized
aaattaaataaacttatgatta

SEQ ID NO: 1392886 - DNA, 22 bp, Artificial Sequence
  chemically synthesized
atataatttatttaatcataag

SEQ ID NO: 1392887 - DNA, 22 bp, Artificial Sequence
  chemically synthesized
aatataatttatttaatcataa

SEQ ID NO: 1392888 - DNA, 22 bp, Artificial Sequence
  chemically synthesized
taatataatttatttaatcata

SEQ ID NO: 1392889 - DNA, 22 bp, Artificial Sequence
  chemically synthesized
ctttaatataatttatttaatc

SEQ ID NO: 1392890 - DNA, 22 bp, Artificial Sequence
  chemically synthesized
aataaacttatgattaaataaa

SEQ ID NO: 1392891 - DNA, 22 bp, Artificial Sequence
  chemically synthesized
cagttgctttaatataatttat

SEQ ID NO: 1392892 - DNA, 22 bp, Artificial Sequence
  chemically synthesized
ttacagttgctttaatataatt

SEQ ID NO: 1392893 - DNA, 22 bp, Artificial Sequence
  chemically synthesized
atgattaaataaattatattaa

SEQ ID NO: 1392894 - DNA, 22 bp, Artificial Sequence
  chemically synthesized
attacagttgctttaatataat

SEQ ID NO: 1392895 - DNA, 22 bp, Artificial Sequence
  chemically synthesized
tgattaaataaattatattaaa

SEQ ID NO: 1392896 - DNA, 22 bp, Artificial Sequence
  chemically synthesized
aataaattatattaaagcaact

SEQ ID NO: 1392897 - DNA, 22 bp, Artificial Sequence
  chemically synthesized
aacatttattacagttgcttta

SEQ ID NO: 1392898 - DNA, 22 bp, Artificial Sequence
  chemically synthesized
gaacatttattacagttgcttt

SEQ ID NO: 1392899 - DNA, 22 bp, Artificial Sequence
  chemically synthesized
tgaacatttattacagttgctt

SEQ ID NO: 1392900 - DNA, 22 bp, Artificial Sequence
  chemically synthesized
tattaaagcaactgtaataaat

SEQ ID NO: 1392901 - DNA, 22 bp, Artificial Sequence
  chemically synthesized
aagcaactgtaataaatgttca

SEQ ID NO: 1392902 - DNA, 22 bp, Artificial Sequence
  chemically synthesized
agaagtgatgagttttgaacat

SEQ ID NO: 1392903 - DNA, 22 bp, Artificial Sequence
  chemically synthesized
taataaatgttcaaaactcatc

SEQ ID NO: 1392904 - DNA, 22 bp, Artificial Sequence
  chemically synthesized
aaaactcatcacttcttaatta

SEQ ID NO: 1392905 - DNA, 22 bp, Artificial Sequence
  chemically synthesized
atcacttcttaattattttact

SEQ ID NO: 1392906 - DNA, 22 bp, Artificial Sequence
  chemically synthesized
cttaattattttactacatttc

SEQ ID NO: 1392907 - DNA, 22 bp, Artificial Sequence
  chemically synthesized
ttaattattttactacatttca

SEQ ID NO: 1392908 - DNA, 22 bp, Artificial Sequence
  chemically synthesized
aattattttactacatttcact

SEQ ID NO: 1392909 - DNA, 22 bp, Artificial Sequence
  chemically synthesized
attattttactacatttcactg

SEQ ID NO: 1392910 - DNA, 22 bp, Artificial Sequence
  chemically synthesized
acaagtgtagacgacagtgaaa

SEQ ID NO: 1392911 - DNA, 22 bp, Artificial Sequence
  chemically synthesized
ttttactacatttcactgtcgt

SEQ ID NO: 1392912 - DNA, 22 bp, Artificial Sequence
  chemically synthesized
tactacatttcactgtcgtcta

SEQ ID NO: 1392913 - DNA, 22 bp, Artificial Sequence
  chemically synthesized
actacatttcactgtcgtctac

SEQ ID NO: 1392914 - DNA, 22 bp, Artificial Sequence
  chemically synthesized
ctacatttcactgtcgtctaca

SEQ ID NO: 1392915 - DNA, 22 bp, Artificial Sequence
  chemically synthesized
catttcactgtcgtctacactt

SEQ ID NO: 1392916 - DNA, 22 bp, Artificial Sequence
  chemically synthesized
cactgtcgtctacacttgtgag

SEQ ID NO: 1392917 - DNA, 22 bp, Artificial Sequence
  chemically synthesized
actgtcgtctacacttgtgagg

SEQ ID NO: 1392918 - DNA, 22 bp, Artificial Sequence
  chemically synthesized
tcgtctacacttgtgaggttat

SEQ ID NO: 1392919 - DNA, 22 bp, Artificial Sequence
  chemically synthesized
cacttgtgaggttatttgtatc

SEQ ID NO: 1392920 - DNA, 22 bp, Artificial Sequence
  chemically synthesized
accatacagataaaaggataca

SEQ ID NO: 1392921 - DNA, 22 bp, Artificial Sequence
  chemically synthesized
gtgaggttatttgtatcctttt

SEQ ID NO: 1392922 - DNA, 22 bp, Artificial Sequence
  chemically synthesized
caccatacagataaaaggatac

SEQ ID NO: 1392923 - DNA, 22 bp, Artificial Sequence
  chemically synthesized
tgaggttatttgtatcctttta

SEQ ID NO: 1392924 - DNA, 22 bp, Artificial Sequence
  chemically synthesized
tcaccatacagataaaaggata

SEQ ID NO: 1392925 - DNA, 22 bp, Artificial Sequence
  chemically synthesized
tttgtatccttttatctgtatg

SEQ ID NO: 1392926 - DNA, 22 bp, Artificial Sequence
  chemically synthesized
tatagcattttcaccatacaga

SEQ ID NO: 1392927 - DNA, 22 bp, Artificial Sequence
  chemically synthesized
gtatccttttatctgtatggtg

SEQ ID NO: 1392928 - DNA, 22 bp, Artificial Sequence
  chemically synthesized
tatccttttatctgtatggtga

SEQ ID NO: 1392929 - DNA, 22 bp, Artificial Sequence
  chemically synthesized
ttatatagcattttcaccatac

SEQ ID NO: 1392930 - DNA, 22 bp, Artificial Sequence
  chemically synthesized
ttatctgtatggtgaaaatgct

SEQ ID NO: 1392931 - DNA, 22 bp, Artificial Sequence
  chemically synthesized
tatctgtatggtgaaaatgcta

SEQ ID NO: 1392932 - DNA, 22 bp, Artificial Sequence
  chemically synthesized
atctgtatggtgaaaatgctat

SEQ ID NO: 1392933 - DNA, 22 bp, Artificial Sequence
  chemically synthesized
tctgtatggtgaaaatgctata

SEQ ID NO: 1392934 - DNA, 22 bp, Artificial Sequence
  chemically synthesized
tatggtgaaaatgctatataat

SEQ ID NO: 1392935 - DNA, 22 bp, Artificial Sequence
  chemically synthesized
ggatgagataggtagtggccaa

SEQ ID NO: 1392936 - DNA, 22 bp, Artificial Sequence
  chemically synthesized
tataataattggccactaccta

SEQ ID NO: 1392937 - DNA, 22 bp, Artificial Sequence
  chemically synthesized
agtgtggagctgggatgagata

SEQ ID NO: 1392938 - DNA, 22 bp, Artificial Sequence
  chemically synthesized
gccactacctatctcatcccag

SEQ ID NO: 1392939 - DNA, 22 bp, Artificial Sequence
  chemically synthesized
ctgagtgtggagctgggatgag

SEQ ID NO: 1392940 - DNA, 22 bp, Artificial Sequence
  chemically synthesized
cctatctcatcccagctccaca

SEQ ID NO: 1392941 - DNA, 22 bp, Artificial Sequence
  chemically synthesized
tctcatcccagctccacactca

SEQ ID NO: 1392942 - DNA, 22 bp, Artificial Sequence
  chemically synthesized
tcaacatgatgttgctgagtgt

SEQ ID NO: 1392943 - DNA, 22 bp, Artificial Sequence
  chemically synthesized
atcccagctccacactcagcaa

SEQ ID NO: 1392944 - DNA, 22 bp, Artificial Sequence
  chemically synthesized
aagctatcaacatgatgttgct

SEQ ID NO: 1392945 - DNA, 22 bp, Artificial Sequence
  chemically synthesized
caagctatcaacatgatgttgc

SEQ ID NO: 1392946 - DNA, 22 bp, Artificial Sequence
  chemically synthesized
cacactcagcaacatcatgttg

SEQ ID NO: 1392947 - DNA, 22 bp, Artificial Sequence
  chemically synthesized
agcaacatcatgttgatagctt

SEQ ID NO: 1392948 - DNA, 22 bp, Artificial Sequence
  chemically synthesized
aaccacatccagtttcaagcta

SEQ ID NO: 1392949 - DNA, 22 bp, Artificial Sequence
  chemically synthesized
caaccacatccagtttcaagct

SEQ ID NO: 1392950 - DNA, 22 bp, Artificial Sequence
  chemically synthesized
atagcttgaaactggatgtggt

SEQ ID NO: 1392951 - DNA, 22 bp, Artificial Sequence
  chemically synthesized
tggtgtaaatacttcaaccaca

SEQ ID NO: 1392952 - DNA, 22 bp, Artificial Sequence
  chemically synthesized
tgtggtgtaaatacttcaacca

SEQ ID NO: 1392953 - DNA, 22 bp, Artificial Sequence
  chemically synthesized
gaaactggatgtggttgaagta

SEQ ID NO: 1392954 - DNA, 22 bp, Artificial Sequence
  chemically synthesized
ctgtggtgtaaatacttcaacc

SEQ ID NO: 1392955 - DNA, 22 bp, Artificial Sequence
  chemically synthesized
aaactggatgtggttgaagtat

SEQ ID NO: 1392956 - DNA, 22 bp, Artificial Sequence
  chemically synthesized
tttctgtggtgtaaatacttca

SEQ ID NO: 1392957 - DNA, 22 bp, Artificial Sequence
  chemically synthesized
atttctgtggtgtaaatacttc

SEQ ID NO: 1392958 - DNA, 22 bp, Artificial Sequence
  chemically synthesized
gatgtggttgaagtatttacac

SEQ ID NO: 1392959 - DNA, 22 bp, Artificial Sequence
  chemically synthesized
cttatttctgtggtgtaaatac

SEQ ID NO: 1392960 - DNA, 22 bp, Artificial Sequence
  chemically synthesized
gcttatttctgtggtgtaaata

SEQ ID NO: 1392961 - DNA, 22 bp, Artificial Sequence
  chemically synthesized
gtgtttgcttatttctgtggtg

SEQ ID NO: 1392962 - DNA, 22 bp, Artificial Sequence
  chemically synthesized
agtgtttgcttatttctgtggt

SEQ ID NO: 1392963 - DNA, 22 bp, Artificial Sequence
  chemically synthesized
aagtatttacaccacagaaata

SEQ ID NO: 1392964 - DNA, 22 bp, Artificial Sequence
  chemically synthesized
ttagtgtttgcttatttctgtg

SEQ ID NO: 1392965 - DNA, 22 bp, Artificial Sequence
  chemically synthesized
tgattcttagtgtttgcttatt

SEQ ID NO: 1392966 - DNA, 22 bp, Artificial Sequence
  chemically synthesized
acaccacagaaataagcaaaca

SEQ ID NO: 1392967 - DNA, 22 bp, Artificial Sequence
  chemically synthesized
caccacagaaataagcaaacac

SEQ ID NO: 1392968 - DNA, 22 bp, Artificial Sequence
  chemically synthesized
aagctatgattcttagtgtttg

SEQ ID NO: 1392969 - DNA, 22 bp, Artificial Sequence
  chemically synthesized
agtgagaaagaactcaagctat

SEQ ID NO: 1392970 - DNA, 22 bp, Artificial Sequence
  chemically synthesized
agaatcatagcttgagttcttt

SEQ ID NO: 1392971 - DNA, 22 bp, Artificial Sequence
  chemically synthesized
accaccagctcagtgagaaaga

SEQ ID NO: 1392972 - DNA, 22 bp, Artificial Sequence
  chemically synthesized
aaccaccagctcagtgagaaag

SEQ ID NO: 1392973 - DNA, 22 bp, Artificial Sequence
  chemically synthesized
taaccaccagctcagtgagaaa

SEQ ID NO: 1392974 - DNA, 22 bp, Artificial Sequence
  chemically synthesized
gagttctttctcactgagctgg

SEQ ID NO: 1392975 - DNA, 22 bp, Artificial Sequence
  chemically synthesized
agttctttctcactgagctggt

SEQ ID NO: 1392976 - DNA, 22 bp, Artificial Sequence
  chemically synthesized
tttctcactgagctggtggtta

SEQ ID NO: 1392977 - DNA, 22 bp, Artificial Sequence
  chemically synthesized
tgtaggtatattttaaccacca

SEQ ID NO: 1392978 - DNA, 22 bp, Artificial Sequence
  chemically synthesized
tctcactgagctggtggttaaa

SEQ ID NO: 1392979 - DNA, 22 bp, Artificial Sequence
  chemically synthesized
ctcactgagctggtggttaaaa

SEQ ID NO: 1392980 - DNA, 22 bp, Artificial Sequence
  chemically synthesized
tcactgagctggtggttaaaat

SEQ ID NO: 1392981 - DNA, 22 bp, Artificial Sequence
  chemically synthesized
actgagctggtggttaaaatat

SEQ ID NO: 1392982 - DNA, 22 bp, Artificial Sequence
  chemically synthesized
agctggtggttaaaatatacct

SEQ ID NO: 1392983 - DNA, 22 bp, Artificial Sequence
  chemically synthesized
gggatgtgtactgtgtaggtat

SEQ ID NO: 1392984 - DNA, 22 bp, Artificial Sequence
  chemically synthesized
gtggttaaaatatacctacaca

SEQ ID NO: 1392985 - DNA, 22 bp, Artificial Sequence
  chemically synthesized
ggggatgtgtactgtgtaggta

SEQ ID NO: 1392986 - DNA, 22 bp, Artificial Sequence
  chemically synthesized
tggggatgtgtactgtgtaggt

SEQ ID NO: 1392987 - DNA, 22 bp, Artificial Sequence
  chemically synthesized
tttggggatgtgtactgtgtag

SEQ ID NO: 1392988 - DNA, 22 bp, Artificial Sequence
  chemically synthesized
aaatatacctacacagtacaca

SEQ ID NO: 1392989 - DNA, 22 bp, Artificial Sequence
  chemically synthesized
tatatgtctctttggggatgtg

SEQ ID NO: 1392990 - DNA, 22 bp, Artificial Sequence
  chemically synthesized
tatatatgtctctttggggatg

SEQ ID NO: 1392991 - DNA, 22 bp, Artificial Sequence
  chemically synthesized
tctatatatgtctctttgggga

SEQ ID NO: 1392992 - DNA, 22 bp, Artificial Sequence
  chemically synthesized
cacagtacacatccccaaagag

SEQ ID NO: 1392993 - DNA, 22 bp, Artificial Sequence
  chemically synthesized
tatctctctatatatgtctctt

SEQ ID NO: 1392994 - DNA, 22 bp, Artificial Sequence
  chemically synthesized
tgtctgtatctctctatatatg

SEQ ID NO: 1392995 - DNA, 22 bp, Artificial Sequence
  chemically synthesized
atgtctgtatctctctatatat

SEQ ID NO: 1392996 - DNA, 22 bp, Artificial Sequence
  chemically synthesized
tatatacttatgtctgtatctc

SEQ ID NO: 1392997 - DNA, 22 bp, Artificial Sequence
  chemically synthesized
tattatatatacttatgtctgt

SEQ ID NO: 1392998 - DNA, 22 bp, Artificial Sequence
  chemically synthesized
atattatatatacttatgtctg

SEQ ID NO: 1392999 - DNA, 22 bp, Artificial Sequence
  chemically synthesized
catatatttatattatatatac

SEQ ID NO: 1393000 - DNA, 22 bp, Artificial Sequence
  chemically synthesized
tctccatatatttatattatat

SEQ ID NO: 1393001 - DNA, 22 bp, Artificial Sequence
  chemically synthesized
atctccatatatttatattata

SEQ ID NO: 1393002 - DNA, 22 bp, Artificial Sequence
  chemically synthesized
tatctccatatatttatattat

SEQ ID NO: 1393003 - DNA, 22 bp, Artificial Sequence
  chemically synthesized
tctttatctccatatatttata

SEQ ID NO: 1393004 - DNA, 22 bp, Artificial Sequence
  chemically synthesized
atctttatctccatatatttat

SEQ ID NO: 1393005 - DNA, 22 bp, Artificial Sequence
  chemically synthesized
tatttatctttatctccatata

SEQ ID NO: 1393006 - DNA, 22 bp, Artificial Sequence
  chemically synthesized
gtatttatctttatctccatat

SEQ ID NO: 1393007 - DNA, 22 bp, Artificial Sequence
  chemically synthesized
tttgtatttatctttatctcca

SEQ ID NO: 1393008 - DNA, 22 bp, Artificial Sequence
  chemically synthesized
tgtcactatttgtatttatctt

SEQ ID NO: 1393009 - DNA, 22 bp, Artificial Sequence
  chemically synthesized
catatctatgtcactatttgta

SEQ ID NO: 1393010 - DNA, 22 bp, Artificial Sequence
  chemically synthesized
acatatctatgtcactatttgt

SEQ ID NO: 1393011 - DNA, 22 bp, Artificial Sequence
  chemically synthesized
aatttacatatctatgtcacta

SEQ ID NO: 1393012 - DNA, 22 bp, Artificial Sequence
  chemically synthesized
gctgaatttacatatctatgtc

SEQ ID NO: 1393013 - DNA, 22 bp, Artificial Sequence
  chemically synthesized
atatagctagctgaatttacat

SEQ ID NO: 1393014 - DNA, 22 bp, Artificial Sequence
  chemically synthesized
ctgatatagctagctgaattta

SEQ ID NO: 1393015 - DNA, 22 bp, Artificial Sequence
  chemically synthesized
gctgatatagctagctgaattt

SEQ ID NO: 1393016 - DNA, 22 bp, Artificial Sequence
  chemically synthesized
ccttgctgatatagctagctga

SEQ ID NO: 1393017 - DNA, 22 bp, Artificial Sequence
  chemically synthesized
accttgctgatatagctagctg

SEQ ID NO: 1393018 - DNA, 22 bp, Artificial Sequence
  chemically synthesized
atttaccttgctgatatagcta

SEQ ID NO: 1393019 - DNA, 22 bp, Artificial Sequence
  chemically synthesized
ctcatttaccttgctgatatag

SEQ ID NO: 1393020 - DNA, 22 bp, Artificial Sequence
  chemically synthesized
actcatttaccttgctgatata

SEQ ID NO: 1393021 - DNA, 22 bp, Artificial Sequence
  chemically synthesized
tactcatttaccttgctgatat

SEQ ID NO: 1393022 - DNA, 22 bp, Artificial Sequence
  chemically synthesized
ttactcatttaccttgctgata

SEQ ID NO: 1393023 - DNA, 22 bp, Artificial Sequence
  chemically synthesized
agctagctatatcagcaaggta

SEQ ID NO: 1393024 - DNA, 22 bp, Artificial Sequence
  chemically synthesized
agtttttactcatttaccttgc

SEQ ID NO: 1393025 - DNA, 22 bp, Artificial Sequence
  chemically synthesized
cagtttttactcatttaccttg

SEQ ID NO: 1393026 - DNA, 22 bp, Artificial Sequence
  chemically synthesized
tcagtttttactcatttacctt

SEQ ID NO: 1393027 - DNA, 22 bp, Artificial Sequence
  chemically synthesized
gctatatcagcaaggtaaatga

SEQ ID NO: 1393028 - DNA, 22 bp, Artificial Sequence
  chemically synthesized
tatcagcaaggtaaatgagtaa

SEQ ID NO: 1393029 - DNA, 22 bp, Artificial Sequence
  chemically synthesized
acgaattttcagtttttactca

SEQ ID NO: 1393030 - DNA, 22 bp, Artificial Sequence
  chemically synthesized
ctgacgaattttcagtttttac

SEQ ID NO: 1393031 - DNA, 22 bp, Artificial Sequence
  chemically synthesized
agttgctgacgaattttcagtt

SEQ ID NO: 1393032 - DNA, 22 bp, Artificial Sequence
  chemically synthesized
gagttgctgacgaattttcagt

SEQ ID NO: 1393033 - DNA, 22 bp, Artificial Sequence
  chemically synthesized
aaaatataacttgagttgctga

SEQ ID NO: 1393034 - DNA, 22 bp, Artificial Sequence
  chemically synthesized
ctaaaaatataacttgagttgc

SEQ ID NO: 1393035 - DNA, 22 bp, Artificial Sequence
  chemically synthesized
aaaattcgtcagcaactcaagt

SEQ ID NO: 1393036 - DNA, 22 bp, Artificial Sequence
  chemically synthesized
actaaaaatataacttgagttg

SEQ ID NO: 1393037 - DNA, 22 bp, Artificial Sequence
  chemically synthesized
tactaaaaatataacttgagtt

SEQ ID NO: 1393038 - DNA, 22 bp, Artificial Sequence
  chemically synthesized
ttactaaaaatataacttgagt

SEQ ID NO: 1393039 - DNA, 22 bp, Artificial Sequence
  chemically synthesized
tttttactaaaaatataacttg

SEQ ID NO: 1393040 - DNA, 22 bp, Artificial Sequence
  chemically synthesized
atttttactaaaaatataactt

SEQ ID NO: 1393041 - DNA, 22 bp, Artificial Sequence
  chemically synthesized
gtcagcaactcaagttatattt

SEQ ID NO: 1393042 - DNA, 22 bp, Artificial Sequence
  chemically synthesized
tatttttactaaaaatataact

SEQ ID NO: 1393043 - DNA, 22 bp, Artificial Sequence
  chemically synthesized
aagttatatttttagtaaaaat

SEQ ID NO: 1393044 - DNA, 22 bp, Artificial Sequence
  chemically synthesized
gaacaaggctttatttttacta

SEQ ID NO: 1393045 - DNA, 22 bp, Artificial Sequence
  chemically synthesized
agaacaaggctttatttttact

SEQ ID NO: 1393046 - DNA, 22 bp, Artificial Sequence
  chemically synthesized
tttagaacaaggctttattttt

SEQ ID NO: 1393047 - DNA, 22 bp, Artificial Sequence
  chemically synthesized
gtttagaacaaggctttatttt

SEQ ID NO: 1393048 - DNA, 22 bp, Artificial Sequence
  chemically synthesized
tatttttagtaaaaataaagcc

SEQ ID NO: 1393049 - DNA, 22 bp, Artificial Sequence
  chemically synthesized
aatttgtttagaacaaggcttt

SEQ ID NO: 1393050 - DNA, 22 bp, Artificial Sequence
  chemically synthesized
ttagtaaaaataaagccttgtt

SEQ ID NO: 1393051 - DNA, 22 bp, Artificial Sequence
  chemically synthesized
tagtaaaaataaagccttgttc

SEQ ID NO: 1393052 - DNA, 22 bp, Artificial Sequence
  chemically synthesized
tgaatttgtttagaacaaggct

SEQ ID NO: 1393053 - DNA, 22 bp, Artificial Sequence
  chemically synthesized
agtaaaaataaagccttgttct

SEQ ID NO: 1393054 - DNA, 22 bp, Artificial Sequence
  chemically synthesized
ctgaatttgtttagaacaaggc

SEQ ID NO: 1393055 - DNA, 22 bp, Artificial Sequence
  chemically synthesized
gtaaaaataaagccttgttcta

SEQ ID NO: 1393056 - DNA, 22 bp, Artificial Sequence
  chemically synthesized
tttctgaatttgtttagaacaa

SEQ ID NO: 1393057 - DNA, 22 bp, Artificial Sequence
  chemically synthesized
gtttctgaatttgtttagaaca

SEQ ID NO: 1393058 - DNA, 22 bp, Artificial Sequence
  chemically synthesized
tgtttgtttctgaatttgttta

SEQ ID NO: 1393059 - DNA, 22 bp, Artificial Sequence
  chemically synthesized
tgtgtttgtttctgaatttgtt

SEQ ID NO: 1393060 - DNA, 22 bp, Artificial Sequence
  chemically synthesized
gtctctgtgtttgtttctgaat

SEQ ID NO: 1393061 - DNA, 22 bp, Artificial Sequence
  chemically synthesized
gttctaaacaaattcagaaaca

SEQ ID NO: 1393062 - DNA, 22 bp, Artificial Sequence
  chemically synthesized
ttctaaacaaattcagaaacaa

SEQ ID NO: 1393063 - DNA, 22 bp, Artificial Sequence
  chemically synthesized
gttagtctctgtgtttgtttct

SEQ ID NO: 1393064 - DNA, 22 bp, Artificial Sequence
  chemically synthesized
taaacaaattcagaaacaaaca

SEQ ID NO: 1393065 - DNA, 22 bp, Artificial Sequence
  chemically synthesized
aacaaattcagaaacaaacaca

SEQ ID NO: 1393066 - DNA, 22 bp, Artificial Sequence
  chemically synthesized
tcactggttagtctctgtgttt

SEQ ID NO: 1393067 - DNA, 22 bp, Artificial Sequence
  chemically synthesized
agaaacaaacacagagactaac

SEQ ID NO: 1393068 - DNA, 22 bp, Artificial Sequence
  chemically synthesized
cataaccagttgtcactggtta

SEQ ID NO: 1393069 - DNA, 22 bp, Artificial Sequence
  chemically synthesized
ttgcataaccagttgtcactgg

SEQ ID NO: 1393070 - DNA, 22 bp, Artificial Sequence
  chemically synthesized
attgcataaccagttgtcactg

SEQ ID NO: 1393071 - DNA, 22 bp, Artificial Sequence
  chemically synthesized
accagtgacaactggttatgca

SEQ ID NO: 1393072 - DNA, 22 bp, Artificial Sequence
  chemically synthesized
tcaggatgtttattgcataacc

SEQ ID NO: 1393073 - DNA, 22 bp, Artificial Sequence
  chemically synthesized
gttatgcaataaacatcctgac

SEQ ID NO: 1393074 - DNA, 22 bp, Artificial Sequence
  chemically synthesized
cacaccgcaattgtcaggatgt

SEQ ID NO: 1393075 - DNA, 22 bp, Artificial Sequence
  chemically synthesized
ttgcacaccgcaattgtcagga

SEQ ID NO: 1393076 - DNA, 22 bp, Artificial Sequence
  chemically synthesized
tgcaataaacatcctgacaatt

SEQ ID NO: 1393077 - DNA, 22 bp, Artificial Sequence
  chemically synthesized
attgcacaccgcaattgtcagg

SEQ ID NO: 1393078 - DNA, 22 bp, Artificial Sequence
  chemically synthesized
tttattgcacaccgcaattgtc

SEQ ID NO: 1393079 - DNA, 22 bp, Artificial Sequence
  chemically synthesized
acaattgcggtgtgcaataaac

SEQ ID NO: 1393080 - DNA, 22 bp, Artificial Sequence
  chemically synthesized
cggtgtgcaataaacagaccca

SEQ ID NO: 1393081 - DNA, 22 bp, Artificial Sequence
  chemically synthesized
tggaaataatggtagatgtggg

SEQ ID NO: 1393082 - DNA, 22 bp, Artificial Sequence
  chemically synthesized
caacatccctgtggaaataatg

SEQ ID NO: 1393083 - DNA, 22 bp, Artificial Sequence
  chemically synthesized
acaacatccctgtggaaataat

SEQ ID NO: 1393084 - DNA, 22 bp, Artificial Sequence
  chemically synthesized
ccattatttccacagggatgtt

SEQ ID NO: 1393085 - DNA, 22 bp, Artificial Sequence
  chemically synthesized
tttccacagggatgttgtaaat

SEQ ID NO: 1393086 - DNA, 22 bp, Artificial Sequence
  chemically synthesized
gccagtgaatggatttacaaca

SEQ ID NO: 1393087 - DNA, 22 bp, Artificial Sequence
  chemically synthesized
ggccagtgaatggatttacaac

SEQ ID NO: 1393088 - DNA, 22 bp, Artificial Sequence
  chemically synthesized
ccacagggatgttgtaaatcca

SEQ ID NO: 1393089 - DNA, 22 bp, Artificial Sequence
  chemically synthesized
cacagggatgttgtaaatccat

SEQ ID NO: 1393090 - DNA, 22 bp, Artificial Sequence
  chemically synthesized
agtaaatgtttggccagtgaat

SEQ ID NO: 1393091 - DNA, 22 bp, Artificial Sequence
  chemically synthesized
taaatccattcactggccaaac

SEQ ID NO: 1393092 - DNA, 22 bp, Artificial Sequence
  chemically synthesized
actggccaaacatttactgagt

SEQ ID NO: 1393093 - DNA, 22 bp, Artificial Sequence
  chemically synthesized
gccaaacatttactgagttatt

SEQ ID NO: 1393094 - DNA, 22 bp, Artificial Sequence
  chemically synthesized
atagggagtagtcaataactca

SEQ ID NO: 1393095 - DNA, 22 bp, Artificial Sequence
  chemically synthesized
actgagttattgactactccct

SEQ ID NO: 1393096 - DNA, 22 bp, Artificial Sequence
  chemically synthesized
ctgagttattgactactcccta

SEQ ID NO: 1393097 - DNA, 22 bp, Artificial Sequence
  chemically synthesized
agttattgactactccctatca

SEQ ID NO: 1393098 - DNA, 22 bp, Artificial Sequence
  chemically synthesized
gatagcacagaaactgataggg

SEQ ID NO: 1393099 - DNA, 22 bp, Artificial Sequence
  chemically synthesized
ttgactactccctatcagtttc

SEQ ID NO: 1393100 - DNA, 22 bp, Artificial Sequence
  chemically synthesized
tctagatagcacagaaactgat

SEQ ID NO: 1393101 - DNA, 22 bp, Artificial Sequence
  chemically synthesized
atctagatagcacagaaactga

SEQ ID NO: 1393102 - DNA, 22 bp, Artificial Sequence
  chemically synthesized
actactccctatcagtttctgt

SEQ ID NO: 1393103 - DNA, 22 bp, Artificial Sequence
  chemically synthesized
tatctagatagcacagaaactg

SEQ ID NO: 1393104 - DNA, 22 bp, Artificial Sequence
  chemically synthesized
ttttatctagatagcacagaaa

SEQ ID NO: 1393105 - DNA, 22 bp, Artificial Sequence
  chemically synthesized
ctccctatcagtttctgtgcta

SEQ ID NO: 1393106 - DNA, 22 bp, Artificial Sequence
  chemically synthesized
cctatcagtttctgtgctatct

SEQ ID NO: 1393107 - DNA, 22 bp, Artificial Sequence
  chemically synthesized
actgttttatctagatagcaca

SEQ ID NO: 1393108 - DNA, 22 bp, Artificial Sequence
  chemically synthesized
tcagtttctgtgctatctagat

SEQ ID NO: 1393109 - DNA, 22 bp, Artificial Sequence
  chemically synthesized
tcactcactgttttatctagat

SEQ ID NO: 1393110 - DNA, 22 bp, Artificial Sequence
  chemically synthesized
gtcactcactgttttatctaga

SEQ ID NO: 1393111 - DNA, 22 bp, Artificial Sequence
  chemically synthesized
tttgtcactcactgttttatct

SEQ ID NO: 1393112 - DNA, 22 bp, Artificial Sequence
  chemically synthesized
ctgtgctatctagataaaacag

SEQ ID NO: 1393113 - DNA, 22 bp, Artificial Sequence
  chemically synthesized
tgtgctatctagataaaacagt

SEQ ID NO: 1393114 - DNA, 22 bp, Artificial Sequence
  chemically synthesized
tgctatctagataaaacagtga

SEQ ID NO: 1393115 - DNA, 22 bp, Artificial Sequence
  chemically synthesized
tctagataaaacagtgagtgac

SEQ ID NO: 1393116 - DNA, 22 bp, Artificial Sequence
  chemically synthesized
gataaaacagtgagtgacaaat

SEQ ID NO: 1393117 - DNA, 22 bp, Artificial Sequence
  chemically synthesized
aggatagccactatttgtcact

SEQ ID NO: 1393118 - DNA, 22 bp, Artificial Sequence
  chemically synthesized
cctaaggatagccactatttgt

SEQ ID NO: 1393119 - DNA, 22 bp, Artificial Sequence
  chemically synthesized
gctccctaaggatagccactat

SEQ ID NO: 1393120 - DNA, 22 bp, Artificial Sequence
  chemically synthesized
agctccctaaggatagccacta

SEQ ID NO: 1393121 - DNA, 22 bp, Artificial Sequence
  chemically synthesized
tagctccctaaggatagccact

SEQ ID NO: 1393122 - DNA, 22 bp, Artificial Sequence
  chemically synthesized
tgtaattttagctccctaagga

SEQ ID NO: 1393123 - DNA, 22 bp, Artificial Sequence
  chemically synthesized
gtgtaattttagctccctaagg

SEQ ID NO: 1393124 - DNA, 22 bp, Artificial Sequence
  chemically synthesized
tgtccatttgtgtaattttagc

SEQ ID NO: 1393125 - DNA, 22 bp, Artificial Sequence
  chemically synthesized
tccttagggagctaaaattaca

SEQ ID NO: 1393126 - DNA, 22 bp, Artificial Sequence
  chemically synthesized
tgtgtccatttgtgtaatttta

SEQ ID NO: 1393127 - DNA, 22 bp, Artificial Sequence
  chemically synthesized
agggagctaaaattacacaaat

SEQ ID NO: 1393128 - DNA, 22 bp, Artificial Sequence
  chemically synthesized
gggagctaaaattacacaaatg

SEQ ID NO: 1393129 - DNA, 22 bp, Artificial Sequence
  chemically synthesized
atagaattctgtgtccatttgt

SEQ ID NO: 1393130 - DNA, 22 bp, Artificial Sequence
  chemically synthesized
aaattacacaaatggacacaga

SEQ ID NO: 1393131 - DNA, 22 bp, Artificial Sequence
  chemically synthesized
cacaaatggacacagaattcta

SEQ ID NO: 1393132 - DNA, 22 bp, Artificial Sequence
  chemically synthesized
tcatacggttgatagaattctg

SEQ ID NO: 1393133 - DNA, 22 bp, Artificial Sequence
  chemically synthesized
gtcatacggttgatagaattct

SEQ ID NO: 1393134 - DNA, 22 bp, Artificial Sequence
  chemically synthesized
ttgtcatacggttgatagaatt

SEQ ID NO: 1393135 - DNA, 22 bp, Artificial Sequence
  chemically synthesized
tatcaaccgtatgacaagagac

SEQ ID NO: 1393136 - DNA, 22 bp, Artificial Sequence
  chemically synthesized
atcccccatggatgtctcttgt

SEQ ID NO: 1393137 - DNA, 22 bp, Artificial Sequence
  chemically synthesized
tcaaccgtatgacaagagacat

SEQ ID NO: 1393138 - DNA, 22 bp, Artificial Sequence
  chemically synthesized
gctcatcccccatggatgtctc

SEQ ID NO: 1393139 - DNA, 22 bp, Artificial Sequence
  chemically synthesized
tcatcacatattagctcatccc

SEQ ID NO: 1393140 - DNA, 22 bp, Artificial Sequence
  chemically synthesized
gtcatcacatattagctcatcc

SEQ ID NO: 1393141 - DNA, 22 bp, Artificial Sequence
  chemically synthesized
tcacaaaatagtttgtcatcac

SEQ ID NO: 1393142 - DNA, 22 bp, Artificial Sequence
  chemically synthesized
gtcacaaaatagtttgtcatca

SEQ ID NO: 1393143 - DNA, 22 bp, Artificial Sequence
  chemically synthesized
atatgtgatgacaaactatttt

SEQ ID NO: 1393144 - DNA, 22 bp, Artificial Sequence
  chemically synthesized
gtatcatatttgtcacaaaata

SEQ ID NO: 1393145 - DNA, 22 bp, Artificial Sequence
  chemically synthesized
agtatcatatttgtcacaaaat

SEQ ID NO: 1393146 - DNA, 22 bp, Artificial Sequence
  chemically synthesized
tagtatcatatttgtcacaaaa

SEQ ID NO: 1393147 - DNA, 22 bp, Artificial Sequence
  chemically synthesized
ttttgtgacaaatatgatacta

SEQ ID NO: 1393148 - DNA, 22 bp, Artificial Sequence
  chemically synthesized
tgtgacaaatatgatactaaaa

SEQ ID NO: 1393149 - DNA, 22 bp, Artificial Sequence
  chemically synthesized
gtgacaaatatgatactaaaat

SEQ ID NO: 1393150 - DNA, 22 bp, Artificial Sequence
  chemically synthesized
tgacaaatatgatactaaaata

SEQ ID NO: 1393151 - DNA, 22 bp, Artificial Sequence
  chemically synthesized
aaatatttatttgcattatctc

SEQ ID NO: 1393152 - DNA, 22 bp, Artificial Sequence
  chemically synthesized
atatagaatatatgtgagataa

SEQ ID NO: 1393153 - DNA, 22 bp, Artificial Sequence
  chemically synthesized
atttgcattatctcacatatat

SEQ ID NO: 1393154 - DNA, 22 bp, Artificial Sequence
  chemically synthesized
tttgcattatctcacatatatt

SEQ ID NO: 1393155 - DNA, 22 bp, Artificial Sequence
  chemically synthesized
gcattatctcacatatattcta

SEQ ID NO: 1393156 - DNA, 22 bp, Artificial Sequence
  chemically synthesized
cattatctcacatatattctat

SEQ ID NO: 1393157 - DNA, 22 bp, Artificial Sequence
  chemically synthesized
catatcagaattcatatagaat

SEQ ID NO: 1393158 - DNA, 22 bp, Artificial Sequence
  chemically synthesized
tctcacatatattctatatgaa

SEQ ID NO: 1393159 - DNA, 22 bp, Artificial Sequence
  chemically synthesized
acatatattctatatgaattct

SEQ ID NO: 1393160 - DNA, 22 bp, Artificial Sequence
  chemically synthesized
tatatgaattctgatatgtaac

SEQ ID NO: 1393161 - DNA, 22 bp, Artificial Sequence
  chemically synthesized
tatgaattctgatatgtaacta

SEQ ID NO: 1393162 - DNA, 22 bp, Artificial Sequence
  chemically synthesized
tgatatgtaactatcatttctt

SEQ ID NO: 1393163 - DNA, 22 bp, Artificial Sequence
  chemically synthesized
ataggtaaaatgaagaaatgat

SEQ ID NO: 1393164 - DNA, 22 bp, Artificial Sequence
  chemically synthesized
atatgtaactatcatttcttca

SEQ ID NO: 1393165 - DNA, 22 bp, Artificial Sequence
  chemically synthesized
gatctcataggtaaaatgaaga

SEQ ID NO: 1393166 - DNA, 22 bp, Artificial Sequence
  chemically synthesized
cctggatctcataggtaaaatg

SEQ ID NO: 1393167 - DNA, 22 bp, Artificial Sequence
  chemically synthesized
acctggatctcataggtaaaat

SEQ ID NO: 1393168 - DNA, 22 bp, Artificial Sequence
  chemically synthesized
tcatttcttcattttacctatg

SEQ ID NO: 1393169 - DNA, 22 bp, Artificial Sequence
  chemically synthesized
acttacctggatctcataggta

SEQ ID NO: 1393170 - DNA, 22 bp, Artificial Sequence
  chemically synthesized
aacttacctggatctcataggt

SEQ ID NO: 1393171 - DNA, 22 bp, Artificial Sequence
  chemically synthesized
cttcattttacctatgagatcc

SEQ ID NO: 1393172 - DNA, 22 bp, Artificial Sequence
  chemically synthesized
ttcattttacctatgagatcca

SEQ ID NO: 1393173 - DNA, 22 bp, Artificial Sequence
  chemically synthesized
cattttacctatgagatccagg

SEQ ID NO: 1393174 - DNA, 22 bp, Artificial Sequence
  chemically synthesized
attttacctatgagatccaggt

SEQ ID NO: 1393175 - DNA, 22 bp, Artificial Sequence
  chemically synthesized
tacctatgagatccaggtaagt

SEQ ID NO: 1393176 - DNA, 22 bp, Artificial Sequence
  chemically synthesized
acctatgagatccaggtaagtt

SEQ ID NO: 1393177 - DNA, 22 bp, Artificial Sequence
  chemically synthesized
cctatgagatccaggtaagtta

SEQ ID NO: 1393178 - DNA, 22 bp, Artificial Sequence
  chemically synthesized
tgagatccaggtaagttaaatc

SEQ ID NO: 1393179 - DNA, 22 bp, Artificial Sequence
  chemically synthesized
aataatgtgatatgatttaact

SEQ ID NO: 1393180 - DNA, 22 bp, Artificial Sequence
  chemically synthesized
gatatagaatctaaataatgtg

SEQ ID NO: 1393181 - DNA, 22 bp, Artificial Sequence
  chemically synthesized
aatcatatcacattatttagat

SEQ ID NO: 1393182 - DNA, 22 bp, Artificial Sequence
  chemically synthesized
attggatatagaatctaaataa

SEQ ID NO: 1393183 - DNA, 22 bp, Artificial Sequence
  chemically synthesized
tttagattctatatccaatcag

SEQ ID NO: 1393184 - DNA, 22 bp, Artificial Sequence
  chemically synthesized
agattctatatccaatcagctg

SEQ ID NO: 1393185 - DNA, 22 bp, Artificial Sequence
  chemically synthesized
gattctatatccaatcagctgt

SEQ ID NO: 1393186 - DNA, 22 bp, Artificial Sequence
  chemically synthesized
tatatccaatcagctgttgact

SEQ ID NO: 1393187 - DNA, 22 bp, Artificial Sequence
  chemically synthesized
tatccaatcagctgttgacttt

SEQ ID NO: 1393188 - DNA, 22 bp, Artificial Sequence
  chemically synthesized
tgaaagacatggataaaagtca

SEQ ID NO: 1393189 - DNA, 22 bp, Artificial Sequence
  chemically synthesized
ttgacttttatccatgtctttc

SEQ ID NO: 1393190 - DNA, 22 bp, Artificial Sequence
  chemically synthesized
acttttatccatgtctttcata

SEQ ID NO: 1393191 - DNA, 22 bp, Artificial Sequence
  chemically synthesized
ttatccatgtctttcatagctt

SEQ ID NO: 1393192 - DNA, 22 bp, Artificial Sequence
  chemically synthesized
tatccatgtctttcatagcttt

SEQ ID NO: 1393193 - DNA, 22 bp, Artificial Sequence
  chemically synthesized
atccatgtctttcatagcttta

SEQ ID NO: 1393194 - DNA, 22 bp, Artificial Sequence
  chemically synthesized
tccatgtctttcatagctttat

SEQ ID NO: 1393195 - DNA, 22 bp, Artificial Sequence
  chemically synthesized
ggagaaaagccaataaagctat

SEQ ID NO: 1393196 - DNA, 22 bp, Artificial Sequence
  chemically synthesized
ctaggagaaaagccaataaagc

SEQ ID NO: 1393197 - DNA, 22 bp, Artificial Sequence
  chemically synthesized
tcatagctttattggcttttct

SEQ ID NO: 1393198 - DNA, 22 bp, Artificial Sequence
  chemically synthesized
catagctttattggcttttctc

SEQ ID NO: 1393199 - DNA, 22 bp, Artificial Sequence
  chemically synthesized
atagctttattggcttttctcc

SEQ ID NO: 1393200 - DNA, 22 bp, Artificial Sequence
  chemically synthesized
tattggcttttctcctagtaat

SEQ ID NO: 1393201 - DNA, 22 bp, Artificial Sequence
  chemically synthesized
acaagagaaagcattactagga

SEQ ID NO: 1393202 - DNA, 22 bp, Artificial Sequence
  chemically synthesized
attggcttttctcctagtaatg

SEQ ID NO: 1393203 - DNA, 22 bp, Artificial Sequence
  chemically synthesized
cacaagagaaagcattactagg

SEQ ID NO: 1393204 - DNA, 22 bp, Artificial Sequence
  chemically synthesized
ttggcttttctcctagtaatgc

SEQ ID NO: 1393205 - DNA, 22 bp, Artificial Sequence
  chemically synthesized
tcacaagagaaagcattactag

SEQ ID NO: 1393206 - DNA, 22 bp, Artificial Sequence
  chemically synthesized
gcttttctcctagtaatgcttt

SEQ ID NO: 1393207 - DNA, 22 bp, Artificial Sequence
  chemically synthesized
ttctcctagtaatgctttctct

SEQ ID NO: 1393208 - DNA, 22 bp, Artificial Sequence
  chemically synthesized
tctcctagtaatgctttctctt

SEQ ID NO: 1393209 - DNA, 22 bp, Artificial Sequence
  chemically synthesized
ctcctagtaatgctttctcttg

SEQ ID NO: 1393210 - DNA, 22 bp, Artificial Sequence
  chemically synthesized
tcctagtaatgctttctcttgt

SEQ ID NO: 1393211 - DNA, 22 bp, Artificial Sequence
  chemically synthesized
ctagtaatgctttctcttgtga

SEQ ID NO: 1393212 - DNA, 22 bp, Artificial Sequence
  chemically synthesized
tatggaatacctttcacaagag

SEQ ID NO: 1393213 - DNA, 22 bp, Artificial Sequence
  chemically synthesized
gtaatgctttctcttgtgaaag

SEQ ID NO: 1393214 - DNA, 22 bp, Artificial Sequence
  chemically synthesized
ataattatatggaatacctttc

SEQ ID NO: 1393215 - DNA, 22 bp, Artificial Sequence
  chemically synthesized
aataattatatggaataccttt

SEQ ID NO: 1393216 - DNA, 22 bp, Artificial Sequence
  chemically synthesized
taataattatatggaatacctt

SEQ ID NO: 1393217 - DNA, 22 bp, Artificial Sequence
  chemically synthesized
tctcttgtgaaaggtattccat

SEQ ID NO: 1393218 - DNA, 22 bp, Artificial Sequence
  chemically synthesized
ctcttgtgaaaggtattccata

SEQ ID NO: 1393219 - DNA, 22 bp, Artificial Sequence
  chemically synthesized
ctttaataattatatggaatac

SEQ ID NO: 1393220 - DNA, 22 bp, Artificial Sequence
  chemically synthesized
tcttgtgaaaggtattccatat

SEQ ID NO: 1393221 - DNA, 22 bp, Artificial Sequence
  chemically synthesized
gctttaataattatatggaata

SEQ ID NO: 1393222 - DNA, 22 bp, Artificial Sequence
  chemically synthesized
ttgtgaaaggtattccatataa

SEQ ID NO: 1393223 - DNA, 22 bp, Artificial Sequence
  chemically synthesized
gtgaaaggtattccatataatt

SEQ ID NO: 1393224 - DNA, 22 bp, Artificial Sequence
  chemically synthesized
tgaaaggtattccatataatta

SEQ ID NO: 1393225 - DNA, 22 bp, Artificial Sequence
  chemically synthesized
gaataaccttgctttaataatt

SEQ ID NO: 1393226 - DNA, 22 bp, Artificial Sequence
  chemically synthesized
ggaataaccttgctttaataat

SEQ ID NO: 1393227 - DNA, 22 bp, Artificial Sequence
  chemically synthesized
acttggaataaccttgctttaa

SEQ ID NO: 1393228 - DNA, 22 bp, Artificial Sequence
  chemically synthesized
aacttggaataaccttgcttta

SEQ ID NO: 1393229 - DNA, 22 bp, Artificial Sequence
  chemically synthesized
catataattattaaagcaaggt

SEQ ID NO: 1393230 - DNA, 22 bp, Artificial Sequence
  chemically synthesized
taacttggaataaccttgcttt

SEQ ID NO: 1393231 - DNA, 22 bp, Artificial Sequence
  chemically synthesized
ctttaacttggaataaccttgc

SEQ ID NO: 1393232 - DNA, 22 bp, Artificial Sequence
  chemically synthesized
ttaaagcaaggttattccaagt

SEQ ID NO: 1393233 - DNA, 22 bp, Artificial Sequence
  chemically synthesized
aagcaaggttattccaagttaa

SEQ ID NO: 1393234 - DNA, 22 bp, Artificial Sequence
  chemically synthesized
ttccaagttaaagtaatccatt

SEQ ID NO: 1393235 - DNA, 22 bp, Artificial Sequence
  chemically synthesized
caagttaaagtaatccattgtg

SEQ ID NO: 1393236 - DNA, 22 bp, Artificial Sequence
  chemically synthesized
atgtgggagacatcaccacaat

SEQ ID NO: 1393237 - DNA, 22 bp, Artificial Sequence
  chemically synthesized
catgtgggagacatcaccacaa

SEQ ID NO: 1393238 - DNA, 22 bp, Artificial Sequence
  chemically synthesized
aagtaatccattgtggtgatgt

SEQ ID NO: 1393239 - DNA, 22 bp, Artificial Sequence
  chemically synthesized
agacagtgatgtttcatgtggg

SEQ ID NO: 1393240 - DNA, 22 bp, Artificial Sequence
  chemically synthesized
tggtgatgtctcccacatgaaa

SEQ ID NO: 1393241 - DNA, 22 bp, Artificial Sequence
  chemically synthesized
cattcagacagtgatgtttcat

SEQ ID NO: 1393242 - DNA, 22 bp, Artificial Sequence
  chemically synthesized
ctccattcagacagtgatgttt

SEQ ID NO: 1393243 - DNA, 22 bp, Artificial Sequence
  chemically synthesized
gctccattcagacagtgatgtt

SEQ ID NO: 1393244 - DNA, 22 bp, Artificial Sequence
  chemically synthesized
ccacatgaaacatcactgtctg

SEQ ID NO: 1393245 - DNA, 22 bp, Artificial Sequence
  chemically synthesized
gtttgctccattcagacagtga

SEQ ID NO: 1393246 - DNA, 22 bp, Artificial Sequence
  chemically synthesized
agtttgctccattcagacagtg

SEQ ID NO: 1393247 - DNA, 22 bp, Artificial Sequence
  chemically synthesized
tagtttgctccattcagacagt

SEQ ID NO: 1393248 - DNA, 22 bp, Artificial Sequence
  chemically synthesized
ttagtttgctccattcagacag

SEQ ID NO: 1393249 - DNA, 22 bp, Artificial Sequence
  chemically synthesized
tttagtttgctccattcagaca

SEQ ID NO: 1393250 - DNA, 22 bp, Artificial Sequence
  chemically synthesized
ttttttagtttgctccattcag

SEQ ID NO: 1393251 - DNA, 22 bp, Artificial Sequence
  chemically synthesized
attttttagtttgctccattca

SEQ ID NO: 1393252 - DNA, 22 bp, Artificial Sequence
  chemically synthesized
tttattttttagtttgctccat

SEQ ID NO: 1393253 - DNA, 22 bp, Artificial Sequence
  chemically synthesized
ttatttattttttagtttgctc

SEQ ID NO: 1393254 - DNA, 22 bp, Artificial Sequence
  chemically synthesized
attatttattttttagtttgct

SEQ ID NO: 1393255 - DNA, 22 bp, Artificial Sequence
  chemically synthesized
tattatttattttttagtttgc

SEQ ID NO: 1393256 - DNA, 22 bp, Artificial Sequence
  chemically synthesized
ttattatttattttttagtttg

SEQ ID NO: 1393257 - DNA, 22 bp, Artificial Sequence
  chemically synthesized
tctgaatggagcaaactaaaaa

SEQ ID NO: 1393258 - DNA, 22 bp, Artificial Sequence
  chemically synthesized
ccttttattatttattttttag

SEQ ID NO: 1393259 - DNA, 22 bp, Artificial Sequence
  chemically synthesized
aatggagcaaactaaaaaataa

SEQ ID NO: 1393260 - DNA, 22 bp, Artificial Sequence
  chemically synthesized
aaaagctgccttttattattta

SEQ ID NO: 1393261 - DNA, 22 bp, Artificial Sequence
  chemically synthesized
aaaaagctgccttttattattt

SEQ ID NO: 1393262 - DNA, 22 bp, Artificial Sequence
  chemically synthesized
aatttaaaaagctgccttttat

SEQ ID NO: 1393263 - DNA, 22 bp, Artificial Sequence
  chemically synthesized
aaaaataaataataaaaggcag

SEQ ID NO: 1393264 - DNA, 22 bp, Artificial Sequence
  chemically synthesized
tcacctaaatttaaaaagctgc

SEQ ID NO: 1393265 - DNA, 22 bp, Artificial Sequence
  chemically synthesized
tgtcacctaaatttaaaaagct

SEQ ID NO: 1393266 - DNA, 22 bp, Artificial Sequence
  chemically synthesized
tgctctgtcacctaaatttaaa

SEQ ID NO: 1393267 - DNA, 22 bp, Artificial Sequence
  chemically synthesized
gtgctctgtcacctaaatttaa

SEQ ID NO: 1393268 - DNA, 22 bp, Artificial Sequence
  chemically synthesized
cttgtgctctgtcacctaaatt

SEQ ID NO: 1393269 - DNA, 22 bp, Artificial Sequence
  chemically synthesized
tttaaatttaggtgacagagca

SEQ ID NO: 1393270 - DNA, 22 bp, Artificial Sequence
  chemically synthesized
ttaaatttaggtgacagagcac

SEQ ID NO: 1393271 - DNA, 22 bp, Artificial Sequence
  chemically synthesized
tagaatctgcttgtgctctgtc

SEQ ID NO: 1393272 - DNA, 22 bp, Artificial Sequence
  chemically synthesized
taaatttaggtgacagagcaca

SEQ ID NO: 1393273 - DNA, 22 bp, Artificial Sequence
  chemically synthesized
atagaatctgcttgtgctctgt

SEQ ID NO: 1393274 - DNA, 22 bp, Artificial Sequence
  chemically synthesized
aaatttaggtgacagagcacaa

SEQ ID NO: 1393275 - DNA, 22 bp, Artificial Sequence
  chemically synthesized
aatttaggtgacagagcacaag

SEQ ID NO: 1393276 - DNA, 22 bp, Artificial Sequence
  chemically synthesized
taatttatagaatctgcttgtg

SEQ ID NO: 1393277 - DNA, 22 bp, Artificial Sequence
  chemically synthesized
aggtgacagagcacaagcagat

SEQ ID NO: 1393278 - DNA, 22 bp, Artificial Sequence
  chemically synthesized
ggtgacagagcacaagcagatt

SEQ ID NO: 1393279 - DNA, 22 bp, Artificial Sequence
  chemically synthesized
ctataatttatagaatctgctt

SEQ ID NO: 1393280 - DNA, 22 bp, Artificial Sequence
  chemically synthesized
tgaaactgctataatttataga

SEQ ID NO: 1393281 - DNA, 22 bp, Artificial Sequence
  chemically synthesized
atgaaactgctataatttatag

SEQ ID NO: 1393282 - DNA, 22 bp, Artificial Sequence
  chemically synthesized
tatgaaactgctataatttata

SEQ ID NO: 1393283 - DNA, 22 bp, Artificial Sequence
  chemically synthesized
ttatgaaactgctataatttat

SEQ ID NO: 1393284 - DNA, 22 bp, Artificial Sequence
  chemically synthesized
ccttttatgaaactgctataat

SEQ ID NO: 1393285 - DNA, 22 bp, Artificial Sequence
  chemically synthesized
accttttatgaaactgctataa

SEQ ID NO: 1393286 - DNA, 22 bp, Artificial Sequence
  chemically synthesized
taccttttatgaaactgctata

SEQ ID NO: 1393287 - DNA, 22 bp, Artificial Sequence
  chemically synthesized
tataaattatagcagtttcata

SEQ ID NO: 1393288 - DNA, 22 bp, Artificial Sequence
  chemically synthesized
ggattttaccttttatgaaact

SEQ ID NO: 1393289 - DNA, 22 bp, Artificial Sequence
  chemically synthesized
taaattatagcagtttcataaa

SEQ ID NO: 1393290 - DNA, 22 bp, Artificial Sequence
  chemically synthesized
gggattttaccttttatgaaac

SEQ ID NO: 1393291 - DNA, 22 bp, Artificial Sequence
  chemically synthesized
ttgggattttaccttttatgaa

SEQ ID NO: 1393292 - DNA, 22 bp, Artificial Sequence
  chemically synthesized
cttgggattttaccttttatga

SEQ ID NO: 1393293 - DNA, 22 bp, Artificial Sequence
  chemically synthesized
tcttgggattttaccttttatg

SEQ ID NO: 1393294 - DNA, 22 bp, Artificial Sequence
  chemically synthesized
tagcagtttcataaaaggtaaa

SEQ ID NO: 1393295 - DNA, 22 bp, Artificial Sequence
  chemically synthesized
agaggttttcttgggattttac

SEQ ID NO: 1393296 - DNA, 22 bp, Artificial Sequence
  chemically synthesized
tgagaggttttcttgggatttt

SEQ ID NO: 1393297 - DNA, 22 bp, Artificial Sequence
  chemically synthesized
cataaaaggtaaaatcccaaga

SEQ ID NO: 1393298 - DNA, 22 bp, Artificial Sequence
  chemically synthesized
ataaaaggtaaaatcccaagaa

SEQ ID NO: 1393299 - DNA, 22 bp, Artificial Sequence
  chemically synthesized
aaaaatgtgaatagttctgaga

SEQ ID NO: 1393300 - DNA, 22 bp, Artificial Sequence
  chemically synthesized
tcagaactattcacatttttga

SEQ ID NO: 1393301 - DNA, 22 bp, Artificial Sequence
  chemically synthesized
gaagacataaattcaaaaatgt

SEQ ID NO: 1393302 - DNA, 22 bp, Artificial Sequence
  chemically synthesized
agaactattcacatttttgaat

SEQ ID NO: 1393303 - DNA, 22 bp, Artificial Sequence
  chemically synthesized
ttcacatttttgaatttatgtc

SEQ ID NO: 1393304 - DNA, 22 bp, Artificial Sequence
  chemically synthesized
acatttttgaatttatgtcttc

SEQ ID NO: 1393305 - DNA, 22 bp, Artificial Sequence
  chemically synthesized
cagtgtaccctagaagacataa

SEQ ID NO: 1393306 - DNA, 22 bp, Artificial Sequence
  chemically synthesized
ttgaatttatgtcttctagggt

SEQ ID NO: 1393307 - DNA, 22 bp, Artificial Sequence
  chemically synthesized
tgaatttatgtcttctagggta

SEQ ID NO: 1393308 - DNA, 22 bp, Artificial Sequence
  chemically synthesized
catcctacagtgtaccctagaa

SEQ ID NO: 1393309 - DNA, 22 bp, Artificial Sequence
  chemically synthesized
gaatttatgtcttctagggtac

SEQ ID NO: 1393310 - DNA, 22 bp, Artificial Sequence
  chemically synthesized
aatttatgtcttctagggtaca

SEQ ID NO: 1393311 - DNA, 22 bp, Artificial Sequence
  chemically synthesized
actacatcctacagtgtaccct

SEQ ID NO: 1393312 - DNA, 22 bp, Artificial Sequence
  chemically synthesized
aactacatcctacagtgtaccc

SEQ ID NO: 1393313 - DNA, 22 bp, Artificial Sequence
  chemically synthesized
taactacatcctacagtgtacc

SEQ ID NO: 1393314 - DNA, 22 bp, Artificial Sequence
  chemically synthesized
atgtcttctagggtacactgta

SEQ ID NO: 1393315 - DNA, 22 bp, Artificial Sequence
  chemically synthesized
tgtcttctagggtacactgtag

SEQ ID NO: 1393316 - DNA, 22 bp, Artificial Sequence
  chemically synthesized
tttaactacatcctacagtgta

SEQ ID NO: 1393317 - DNA, 22 bp, Artificial Sequence
  chemically synthesized
ctttaactacatcctacagtgt

SEQ ID NO: 1393318 - DNA, 22 bp, Artificial Sequence
  chemically synthesized
ttctttaactacatcctacagt

SEQ ID NO: 1393319 - DNA, 22 bp, Artificial Sequence
  chemically synthesized
cttctttaactacatcctacag

SEQ ID NO: 1393320 - DNA, 22 bp, Artificial Sequence
  chemically synthesized
tcttctttaactacatcctaca

SEQ ID NO: 1393321 - DNA, 22 bp, Artificial Sequence
  chemically synthesized
ctagggtacactgtaggatgta

SEQ ID NO: 1393322 - DNA, 22 bp, Artificial Sequence
  chemically synthesized
ttcttctttaactacatcctac

SEQ ID NO: 1393323 - DNA, 22 bp, Artificial Sequence
  chemically synthesized
tagggtacactgtaggatgtag

SEQ ID NO: 1393324 - DNA, 22 bp, Artificial Sequence
  chemically synthesized
tttcttctttaactacatccta

SEQ ID NO: 1393325 - DNA, 22 bp, Artificial Sequence
  chemically synthesized
ttttcttctttaactacatcct

SEQ ID NO: 1393326 - DNA, 22 bp, Artificial Sequence
  chemically synthesized
gggtacactgtaggatgtagtt

SEQ ID NO: 1393327 - DNA, 22 bp, Artificial Sequence
  chemically synthesized
ttttttcttctttaactacatc

SEQ ID NO: 1393328 - DNA, 22 bp, Artificial Sequence
  chemically synthesized
cttttttcttctttaactacat

SEQ ID NO: 1393329 - DNA, 22 bp, Artificial Sequence
  chemically synthesized
tcttttttcttctttaactaca

SEQ ID NO: 1393330 - DNA, 22 bp, Artificial Sequence
  chemically synthesized
ttcttttttcttctttaactac

SEQ ID NO: 1393331 - DNA, 22 bp, Artificial Sequence
  chemically synthesized
tttcttttttcttctttaacta

SEQ ID NO: 1393332 - DNA, 22 bp, Artificial Sequence
  chemically synthesized
ttttcttttttcttctttaact

SEQ ID NO: 1393333 - DNA, 22 bp, Artificial Sequence
  chemically synthesized
tttttttcttttttcttcttta

SEQ ID NO: 1393334 - DNA, 22 bp, Artificial Sequence
  chemically synthesized
taggatgtagttaaagaagaaa

SEQ ID NO: 1393335 - DNA, 22 bp, Artificial Sequence
  chemically synthesized
atttttttcttttttcttcttt

SEQ ID NO: 1393336 - DNA, 22 bp, Artificial Sequence
  chemically synthesized
ttatttttttcttttttcttct

SEQ ID NO: 1393337 - DNA, 22 bp, Artificial Sequence
  chemically synthesized
aaaaacctcttatttttttctt

SEQ ID NO: 1393338 - DNA, 22 bp, Artificial Sequence
  chemically synthesized
aagaagaaaaaagaaaaaaata

SEQ ID NO: 1393339 - DNA, 22 bp, Artificial Sequence
  chemically synthesized
tattgaaaaacctcttattttt

SEQ ID NO: 1393340 - DNA, 22 bp, Artificial Sequence
  chemically synthesized
atattatattgaaaaacctctt

SEQ ID NO: 1393341 - DNA, 22 bp, Artificial Sequence
  chemically synthesized
gaattcatattatattgaaaaa

SEQ ID NO: 1393342 - DNA, 22 bp, Artificial Sequence
  chemically synthesized
tcatgataaaactggaattcat

SEQ ID NO: 1393343 - DNA, 22 bp, Artificial Sequence
  chemically synthesized
ttcaatataatatgaattccag

SEQ ID NO: 1393344 - DNA, 22 bp, Artificial Sequence
  chemically synthesized
tcaatataatatgaattccagt

SEQ ID NO: 1393345 - DNA, 22 bp, Artificial Sequence
  chemically synthesized
caatataatatgaattccagtt

SEQ ID NO: 1393346 - DNA, 22 bp, Artificial Sequence
  chemically synthesized
ctatcatgataaaactggaatt

SEQ ID NO: 1393347 - DNA, 22 bp, Artificial Sequence
  chemically synthesized
aatataatatgaattccagttt

SEQ ID NO: 1393348 - DNA, 22 bp, Artificial Sequence
  chemically synthesized
tcctatcatgataaaactggaa

SEQ ID NO: 1393349 - DNA, 22 bp, Artificial Sequence
  chemically synthesized
tattctcctatcatgataaaac

SEQ ID NO: 1393350 - DNA, 22 bp, Artificial Sequence
  chemically synthesized
cagtctatattctcctatcatg

SEQ ID NO: 1393351 - DNA, 22 bp, Artificial Sequence
  chemically synthesized
cagttttatcatgataggagaa

SEQ ID NO: 1393352 - DNA, 22 bp, Artificial Sequence
  chemically synthesized
ctacagtctatattctcctatc

SEQ ID NO: 1393353 - DNA, 22 bp, Artificial Sequence
  chemically synthesized
cctacagtctatattctcctat

SEQ ID NO: 1393354 - DNA, 22 bp, Artificial Sequence
  chemically synthesized
tatcatgataggagaatataga

SEQ ID NO: 1393355 - DNA, 22 bp, Artificial Sequence
  chemically synthesized
tacttcctacagtctatattct

SEQ ID NO: 1393356 - DNA, 22 bp, Artificial Sequence
  chemically synthesized
atcatgataggagaatatagac

SEQ ID NO: 1393357 - DNA, 22 bp, Artificial Sequence
  chemically synthesized
tcatgataggagaatatagact

SEQ ID NO: 1393358 - DNA, 22 bp, Artificial Sequence
  chemically synthesized
gtaccattatacttcctacagt

SEQ ID NO: 1393359 - DNA, 22 bp, Artificial Sequence
  chemically synthesized
taggaagtataatggtaccaga

SEQ ID NO: 1393360 - DNA, 22 bp, Artificial Sequence
  chemically synthesized
acaaataaaagcatctggtacc

SEQ ID NO: 1393361 - DNA, 22 bp, Artificial Sequence
  chemically synthesized
gtaataattgacaaataaaagc

SEQ ID NO: 1393362 - DNA, 22 bp, Artificial Sequence
  chemically synthesized
agtaataattgacaaataaaag

SEQ ID NO: 1393363 - DNA, 22 bp, Artificial Sequence
  chemically synthesized
aaatttagtaataattgacaaa

SEQ ID NO: 1393364 - DNA, 22 bp, Artificial Sequence
  chemically synthesized
taaaatttagtaataattgaca

SEQ ID NO: 1393365 - DNA, 22 bp, Artificial Sequence
  chemically synthesized
ctaaaatttagtaataattgac

SEQ ID NO: 1393366 - DNA, 22 bp, Artificial Sequence
  chemically synthesized
tctaaaatttagtaataattga

SEQ ID NO: 1393367 - DNA, 22 bp, Artificial Sequence
  chemically synthesized
ttctaaaatttagtaataattg

SEQ ID NO: 1393368 - DNA, 22 bp, Artificial Sequence
  chemically synthesized
tttctaaaatttagtaataatt

SEQ ID NO: 1393369 - DNA, 22 bp, Artificial Sequence
  chemically synthesized
ttttctaaaatttagtaataat

SEQ ID NO: 1393370 - DNA, 22 bp, Artificial Sequence
  chemically synthesized
ttatttgtcaattattactaaa

SEQ ID NO: 1393371 - DNA, 22 bp, Artificial Sequence
  chemically synthesized
ttttttctaaaatttagtaata

SEQ ID NO: 1393372 - DNA, 22 bp, Artificial Sequence
  chemically synthesized
tatttgtcaattattactaaat

SEQ ID NO: 1393373 - DNA, 22 bp, Artificial Sequence
  chemically synthesized
cttttttctaaaatttagtaat

SEQ ID NO: 1393374 - DNA, 22 bp, Artificial Sequence
  chemically synthesized
atttgtcaattattactaaatt

SEQ ID NO: 1393375 - DNA, 22 bp, Artificial Sequence
  chemically synthesized
tcttttttctaaaatttagtaa

SEQ ID NO: 1393376 - DNA, 22 bp, Artificial Sequence
  chemically synthesized
tttgtcaattattactaaattt

SEQ ID NO: 1393377 - DNA, 22 bp, Artificial Sequence
  chemically synthesized
ttcttttttctaaaatttagta

SEQ ID NO: 1393378 - DNA, 22 bp, Artificial Sequence
  chemically synthesized
gtcaattattactaaattttag

SEQ ID NO: 1393379 - DNA, 22 bp, Artificial Sequence
  chemically synthesized
tcaattattactaaattttaga

SEQ ID NO: 1393380 - DNA, 22 bp, Artificial Sequence
  chemically synthesized
gaatttttcttttttctaaaat

SEQ ID NO: 1393381 - DNA, 22 bp, Artificial Sequence
  chemically synthesized
ttactaaattttagaaaaaaga

SEQ ID NO: 1393382 - DNA, 22 bp, Artificial Sequence
  chemically synthesized
ctaaattttagaaaaaagaaaa

SEQ ID NO: 1393383 - DNA, 22 bp, Artificial Sequence
  chemically synthesized
aaaaactagaatttttcttttt

SEQ ID NO: 1393384 - DNA, 22 bp, Artificial Sequence
  chemically synthesized
aattttagaaaaaagaaaaatt

SEQ ID NO: 1393385 - DNA, 22 bp, Artificial Sequence
  chemically synthesized
tagaaaaaagaaaaattctagt

SEQ ID NO: 1393386 - DNA, 22 bp, Artificial Sequence
  chemically synthesized
gaagactcaaaaactagaattt

SEQ ID NO: 1393387 - DNA, 22 bp, Artificial Sequence
  chemically synthesized
agaaaaaagaaaaattctagtt

SEQ ID NO: 1393388 - DNA, 22 bp, Artificial Sequence
  chemically synthesized
gaaaaaagaaaaattctagttt

SEQ ID NO: 1393389 - DNA, 22 bp, Artificial Sequence
  chemically synthesized
agtctggaagactcaaaaacta

SEQ ID NO: 1393390 - DNA, 22 bp, Artificial Sequence
  chemically synthesized
tagtttttgagtcttccagact

SEQ ID NO: 1393391 - DNA, 22 bp, Artificial Sequence
  chemically synthesized
gtttttgagtcttccagactga

SEQ ID NO: 1393392 - DNA, 22 bp, Artificial Sequence
  chemically synthesized
ttgagtcttccagactgagcac

SEQ ID NO: 1393393 - DNA, 22 bp, Artificial Sequence
  chemically synthesized
tatgtcaaatgggtgctcagtc

SEQ ID NO: 1393394 - DNA, 22 bp, Artificial Sequence
  chemically synthesized
tgagtcttccagactgagcacc

SEQ ID NO: 1393395 - DNA, 22 bp, Artificial Sequence
  chemically synthesized
gagtcttccagactgagcaccc

SEQ ID NO: 1393396 - DNA, 22 bp, Artificial Sequence
  chemically synthesized
agtcttccagactgagcaccca

SEQ ID NO: 1393397 - DNA, 22 bp, Artificial Sequence
  chemically synthesized
aattgtatgtcaaatgggtgct

SEQ ID NO: 1393398 - DNA, 22 bp, Artificial Sequence
  chemically synthesized
ccagactgagcacccatttgac

SEQ ID NO: 1393399 - DNA, 22 bp, Artificial Sequence
  chemically synthesized
cagactgagcacccatttgaca

SEQ ID NO: 1393400 - DNA, 22 bp, Artificial Sequence
  chemically synthesized
gtaagttaaattgtatgtcaaa

SEQ ID NO: 1393401 - DNA, 22 bp, Artificial Sequence
  chemically synthesized
ggtaagttaaattgtatgtcaa

SEQ ID NO: 1393402 - DNA, 22 bp, Artificial Sequence
  chemically synthesized
tggtaagttaaattgtatgtca

SEQ ID NO: 1393403 - DNA, 22 bp, Artificial Sequence
  chemically synthesized
agcacccatttgacatacaatt

SEQ ID NO: 1393404 - DNA, 22 bp, Artificial Sequence
  chemically synthesized
tcatattttggtaagttaaatt

SEQ ID NO: 1393405 - DNA, 22 bp, Artificial Sequence
  chemically synthesized
gacatacaatttaacttaccaa

SEQ ID NO: 1393406 - DNA, 22 bp, Artificial Sequence
  chemically synthesized
acatacaatttaacttaccaaa

SEQ ID NO: 1393407 - DNA, 22 bp, Artificial Sequence
  chemically synthesized
ataacgtagctatcatattttg

SEQ ID NO: 1393408 - DNA, 22 bp, Artificial Sequence
  chemically synthesized
cataacgtagctatcatatttt

SEQ ID NO: 1393409 - DNA, 22 bp, Artificial Sequence
  chemically synthesized
aacttaccaaaatatgatagct

SEQ ID NO: 1393410 - DNA, 22 bp, Artificial Sequence
  chemically synthesized
gcttcataacgtagctatcata

SEQ ID NO: 1393411 - DNA, 22 bp, Artificial Sequence
  chemically synthesized
acttaccaaaatatgatagcta

SEQ ID NO: 1393412 - DNA, 22 bp, Artificial Sequence
  chemically synthesized
accaaaatatgatagctacgtt

SEQ ID NO: 1393413 - DNA, 22 bp, Artificial Sequence
  chemically synthesized
ccaaaatatgatagctacgtta

SEQ ID NO: 1393414 - DNA, 22 bp, Artificial Sequence
  chemically synthesized
tgtctagcttcataacgtagct

SEQ ID NO: 1393415 - DNA, 22 bp, Artificial Sequence
  chemically synthesized
aaacatatcattgtgtctagct

SEQ ID NO: 1393416 - DNA, 22 bp, Artificial Sequence
  chemically synthesized
gaaacatatcattgtgtctagc

SEQ ID NO: 1393417 - DNA, 22 bp, Artificial Sequence
  chemically synthesized
cgttatgaagctagacacaatg

SEQ ID NO: 1393418 - DNA, 22 bp, Artificial Sequence
  chemically synthesized
tacatttgaaacatatcattgt

SEQ ID NO: 1393419 - DNA, 22 bp, Artificial Sequence
  chemically synthesized
tgaagctagacacaatgatatg

SEQ ID NO: 1393420 - DNA, 22 bp, Artificial Sequence
  chemically synthesized
ttatacatttgaaacatatcat

SEQ ID NO: 1393421 - DNA, 22 bp, Artificial Sequence
  chemically synthesized
attattatacatttgaaacata

SEQ ID NO: 1393422 - DNA, 22 bp, Artificial Sequence
  chemically synthesized
gacacaatgatatgtttcaaat

SEQ ID NO: 1393423 - DNA, 22 bp, Artificial Sequence
  chemically synthesized
tgattattatacatttgaaaca

SEQ ID NO: 1393424 - DNA, 22 bp, Artificial Sequence
  chemically synthesized
ctgattattatacatttgaaac

SEQ ID NO: 1393425 - DNA, 22 bp, Artificial Sequence
  chemically synthesized
caaatgtataataatcagaaat

SEQ ID NO: 1393426 - DNA, 22 bp, Artificial Sequence
  chemically synthesized
aaatgtataataatcagaaata

SEQ ID NO: 1393427 - DNA, 22 bp, Artificial Sequence
  chemically synthesized
tataaaaccaaataatgggata

SEQ ID NO: 1393428 - DNA, 22 bp, Artificial Sequence
  chemically synthesized
tgtatatgttatataaaaccaa

SEQ ID NO: 1393429 - DNA, 22 bp, Artificial Sequence
  chemically synthesized
tttggttttatataacatatac

SEQ ID NO: 1393430 - DNA, 22 bp, Artificial Sequence
  chemically synthesized
acatatgggctatgtatatgtt

SEQ ID NO: 1393431 - DNA, 22 bp, Artificial Sequence
  chemically synthesized
gacatatgggctatgtatatgt

SEQ ID NO: 1393432 - DNA, 22 bp, Artificial Sequence
  chemically synthesized
ggttttatataacatatacata

SEQ ID NO: 1393433 - DNA, 22 bp, Artificial Sequence
  chemically synthesized
tgacatatgggctatgtatatg

SEQ ID NO: 1393434 - DNA, 22 bp, Artificial Sequence
  chemically synthesized
gttttatataacatatacatag

SEQ ID NO: 1393435 - DNA, 22 bp, Artificial Sequence
  chemically synthesized
ctttgacatatgggctatgtat

SEQ ID NO: 1393436 - DNA, 22 bp, Artificial Sequence
  chemically synthesized
cctttgacatatgggctatgta

SEQ ID NO: 1393437 - DNA, 22 bp, Artificial Sequence
  chemically synthesized
tatataacatatacatagccca

SEQ ID NO: 1393438 - DNA, 22 bp, Artificial Sequence
  chemically synthesized
atataacatatacatagcccat

SEQ ID NO: 1393439 - DNA, 22 bp, Artificial Sequence
  chemically synthesized
tataacatatacatagcccata

SEQ ID NO: 1393440 - DNA, 22 bp, Artificial Sequence
  chemically synthesized
tgtcttcctttgacatatgggc

SEQ ID NO: 1393441 - DNA, 22 bp, Artificial Sequence
  chemically synthesized
gtgtcttcctttgacatatggg

SEQ ID NO: 1393442 - DNA, 22 bp, Artificial Sequence
  chemically synthesized
tgtgtcttcctttgacatatgg

SEQ ID NO: 1393443 - DNA, 22 bp, Artificial Sequence
  chemically synthesized
ttgtgtcttcctttgacatatg

SEQ ID NO: 1393444 - DNA, 22 bp, Artificial Sequence
  chemically synthesized
tttgtgtcttcctttgacatat

SEQ ID NO: 1393445 - DNA, 22 bp, Artificial Sequence
  chemically synthesized
ttttttgtgtcttcctttgaca

SEQ ID NO: 1393446 - DNA, 22 bp, Artificial Sequence
  chemically synthesized
aaactattttttgtgtcttcct

SEQ ID NO: 1393447 - DNA, 22 bp, Artificial Sequence
  chemically synthesized
aaccaggtactaaaactatttt

SEQ ID NO: 1393448 - DNA, 22 bp, Artificial Sequence
  chemically synthesized
caaccaggtactaaaactattt

SEQ ID NO: 1393449 - DNA, 22 bp, Artificial Sequence
  chemically synthesized
atcaaaaatttcaaccaggtac

SEQ ID NO: 1393450 - DNA, 22 bp, Artificial Sequence
  chemically synthesized
aatcaaaaatttcaaccaggta

SEQ ID NO: 1393451 - DNA, 22 bp, Artificial Sequence
  chemically synthesized
taatcaaaaatttcaaccaggt

SEQ ID NO: 1393452 - DNA, 22 bp, Artificial Sequence
  chemically synthesized
ttaatcaaaaatttcaaccagg

SEQ ID NO: 1393453 - DNA, 22 bp, Artificial Sequence
  chemically synthesized
tttaatcaaaaatttcaaccag

SEQ ID NO: 1393454 - DNA, 22 bp, Artificial Sequence
  chemically synthesized
aattttttaatcaaaaatttca

SEQ ID NO: 1393455 - DNA, 22 bp, Artificial Sequence
  chemically synthesized
tagtacctggttgaaatttttg

SEQ ID NO: 1393456 - DNA, 22 bp, Artificial Sequence
  chemically synthesized
agtacctggttgaaatttttga

SEQ ID NO: 1393457 - DNA, 22 bp, Artificial Sequence
  chemically synthesized
gtacctggttgaaatttttgat

SEQ ID NO: 1393458 - DNA, 22 bp, Artificial Sequence
  chemically synthesized
gttgaaatttttgattaaaaaa

SEQ ID NO: 1393459 - DNA, 22 bp, Artificial Sequence
  chemically synthesized
aaggatcagctaaattttttaa

SEQ ID NO: 1393460 - DNA, 22 bp, Artificial Sequence
  chemically synthesized
aaatttttgattaaaaaattta

SEQ ID NO: 1393461 - DNA, 22 bp, Artificial Sequence
  chemically synthesized
tcaaggatcagctaaatttttt

SEQ ID NO: 1393462 - DNA, 22 bp, Artificial Sequence
  chemically synthesized
ctcaaggatcagctaaattttt

SEQ ID NO: 1393463 - DNA, 22 bp, Artificial Sequence
  chemically synthesized
ttgattaaaaaatttagctgat

SEQ ID NO: 1393464 - DNA, 22 bp, Artificial Sequence
  chemically synthesized
aatttctcaaggatcagctaaa

SEQ ID NO: 1393465 - DNA, 22 bp, Artificial Sequence
  chemically synthesized
tgattaaaaaatttagctgatc

SEQ ID NO: 1393466 - DNA, 22 bp, Artificial Sequence
  chemically synthesized
gattaaaaaatttagctgatcc

SEQ ID NO: 1393467 - DNA, 22 bp, Artificial Sequence
  chemically synthesized
attaaaaaatttagctgatcct

SEQ ID NO: 1393468 - DNA, 22 bp, Artificial Sequence
  chemically synthesized
agttaaatttctcaaggatcag

SEQ ID NO: 1393469 - DNA, 22 bp, Artificial Sequence
  chemically synthesized
aaaaatttagctgatccttgag

SEQ ID NO: 1393470 - DNA, 22 bp, Artificial Sequence
  chemically synthesized
gattcagttaaatttctcaagg

SEQ ID NO: 1393471 - DNA, 22 bp, Artificial Sequence
  chemically synthesized
agattcagttaaatttctcaag

SEQ ID NO: 1393472 - DNA, 22 bp, Artificial Sequence
  chemically synthesized
agctgatccttgagaaatttaa

SEQ ID NO: 1393473 - DNA, 22 bp, Artificial Sequence
  chemically synthesized
gctgatccttgagaaatttaac

SEQ ID NO: 1393474 - DNA, 22 bp, Artificial Sequence
  chemically synthesized
atccttgagaaatttaactgaa

SEQ ID NO: 1393475 - DNA, 22 bp, Artificial Sequence
  chemically synthesized
tgaataagtttagattcagtta

SEQ ID NO: 1393476 - DNA, 22 bp, Artificial Sequence
  chemically synthesized
gtgaataagtttagattcagtt

SEQ ID NO: 1393477 - DNA, 22 bp, Artificial Sequence
  chemically synthesized
tgtgaataagtttagattcagt

SEQ ID NO: 1393478 - DNA, 22 bp, Artificial Sequence
  chemically synthesized
ttgtgaataagtttagattcag

SEQ ID NO: 1393479 - DNA, 22 bp, Artificial Sequence
  chemically synthesized
gagaaatttaactgaatctaaa

SEQ ID NO: 1393480 - DNA, 22 bp, Artificial Sequence
  chemically synthesized
agaaatttaactgaatctaaac

SEQ ID NO: 1393481 - DNA, 22 bp, Artificial Sequence
  chemically synthesized
aactgaatctaaacttattcac

SEQ ID NO: 1393482 - DNA, 22 bp, Artificial Sequence
  chemically synthesized
actgaatctaaacttattcaca

SEQ ID NO: 1393483 - DNA, 22 bp, Artificial Sequence
  chemically synthesized
aatctaaacttattcacaaaag

SEQ ID NO: 1393484 - DNA, 22 bp, Artificial Sequence
  chemically synthesized
aacttattcacaaaagcttaca

SEQ ID NO: 1393485 - DNA, 22 bp, Artificial Sequence
  chemically synthesized
attcacaaaagcttacattcac

SEQ ID NO: 1393486 - DNA, 22 bp, Artificial Sequence
  chemically synthesized
ttcacaaaagcttacattcact

SEQ ID NO: 1393487 - DNA, 22 bp, Artificial Sequence
  chemically synthesized
acaaaagcttacattcactttg

SEQ ID NO: 1393488 - DNA, 22 bp, Artificial Sequence
  chemically synthesized
aacatcaaataagccaaagtga

SEQ ID NO: 1393489 - DNA, 22 bp, Artificial Sequence
  chemically synthesized
taaacatcaaataagccaaagt

SEQ ID NO: 1393490 - DNA, 22 bp, Artificial Sequence
  chemically synthesized
ctaaacatcaaataagccaaag

SEQ ID NO: 1393491 - DNA, 22 bp, Artificial Sequence
  chemically synthesized
tctaaacatcaaataagccaaa

SEQ ID NO: 1393492 - DNA, 22 bp, Artificial Sequence
  chemically synthesized
acattcactttggcttatttga

SEQ ID NO: 1393493 - DNA, 22 bp, Artificial Sequence
  chemically synthesized
cattcactttggcttatttgat

SEQ ID NO: 1393494 - DNA, 22 bp, Artificial Sequence
  chemically synthesized
aaataattttctaaacatcaaa

SEQ ID NO: 1393495 - DNA, 22 bp, Artificial Sequence
  chemically synthesized
actttggcttatttgatgttta

SEQ ID NO: 1393496 - DNA, 22 bp, Artificial Sequence
  chemically synthesized
tggcttatttgatgtttagaaa

SEQ ID NO: 1393497 - DNA, 22 bp, Artificial Sequence
  chemically synthesized
ggcttatttgatgtttagaaaa

SEQ ID NO: 1393498 - DNA, 22 bp, Artificial Sequence
  chemically synthesized
gcttatttgatgtttagaaaat

SEQ ID NO: 1393499 - DNA, 22 bp, Artificial Sequence
  chemically synthesized
atttgatgtttagaaaattatt

SEQ ID NO: 1393500 - DNA, 22 bp, Artificial Sequence
  chemically synthesized
tttgatgtttagaaaattattt

SEQ ID NO: 1393501 - DNA, 22 bp, Artificial Sequence
  chemically synthesized
gatgtttagaaaattattttaa

SEQ ID NO: 1393502 - DNA, 22 bp, Artificial Sequence
  chemically synthesized
atgtttagaaaattattttaat

SEQ ID NO: 1393503 - DNA, 22 bp, Artificial Sequence
  chemically synthesized
caagaataaaatcattaaaata

SEQ ID NO: 1393504 - DNA, 22 bp, Artificial Sequence
  chemically synthesized
agaaaattattttaatgatttt

SEQ ID NO: 1393505 - DNA, 22 bp, Artificial Sequence
  chemically synthesized
gaaaattattttaatgatttta

SEQ ID NO: 1393506 - DNA, 22 bp, Artificial Sequence
  chemically synthesized
agcaaatgctgcaagaataaaa

SEQ ID NO: 1393507 - DNA, 22 bp, Artificial Sequence
  chemically synthesized
ttttaatgattttattcttgca

SEQ ID NO: 1393508 - DNA, 22 bp, Artificial Sequence
  chemically synthesized
ttcagcaaatgctgcaagaata

SEQ ID NO: 1393509 - DNA, 22 bp, Artificial Sequence
  chemically synthesized
taatgattttattcttgcagca

SEQ ID NO: 1393510 - DNA, 22 bp, Artificial Sequence
  chemically synthesized
aatgattttattcttgcagcat

SEQ ID NO: 1393511 - DNA, 22 bp, Artificial Sequence
  chemically synthesized
atgattttattcttgcagcatt

SEQ ID NO: 1393512 - DNA, 22 bp, Artificial Sequence
  chemically synthesized
tattcttgcagcatttgctgaa

SEQ ID NO: 1393513 - DNA, 22 bp, Artificial Sequence
  chemically synthesized
acaataacactattcagcaaat

SEQ ID NO: 1393514 - DNA, 22 bp, Artificial Sequence
  chemically synthesized
attcttgcagcatttgctgaat

SEQ ID NO: 1393515 - DNA, 22 bp, Artificial Sequence
  chemically synthesized
aacaataacactattcagcaaa

SEQ ID NO: 1393516 - DNA, 22 bp, Artificial Sequence
  chemically synthesized
ttcttgcagcatttgctgaata

SEQ ID NO: 1393517 - DNA, 22 bp, Artificial Sequence
  chemically synthesized
ttaacaataacactattcagca

SEQ ID NO: 1393518 - DNA, 22 bp, Artificial Sequence
  chemically synthesized
ttgcagcatttgctgaatagtg

SEQ ID NO: 1393519 - DNA, 22 bp, Artificial Sequence
  chemically synthesized
ttcttaacaataacactattca

SEQ ID NO: 1393520 - DNA, 22 bp, Artificial Sequence
  chemically synthesized
gcagcatttgctgaatagtgtt

SEQ ID NO: 1393521 - DNA, 22 bp, Artificial Sequence
  chemically synthesized
cagcatttgctgaatagtgtta

SEQ ID NO: 1393522 - DNA, 22 bp, Artificial Sequence
  chemically synthesized
gctgaatagtgttattgttaag

SEQ ID NO: 1393523 - DNA, 22 bp, Artificial Sequence
  chemically synthesized
agaggtgttattcttaacaata

SEQ ID NO: 1393524 - DNA, 22 bp, Artificial Sequence
  chemically synthesized
ctgaatagtgttattgttaaga

SEQ ID NO: 1393525 - DNA, 22 bp, Artificial Sequence
  chemically synthesized
cagaggtgttattcttaacaat

SEQ ID NO: 1393526 - DNA, 22 bp, Artificial Sequence
  chemically synthesized
aatagtgttattgttaagaata

SEQ ID NO: 1393527 - DNA, 22 bp, Artificial Sequence
  chemically synthesized
ttgttaagaataacacctctga

SEQ ID NO: 1393528 - DNA, 22 bp, Artificial Sequence
  chemically synthesized
aggaagtatcacttcagaggtg

SEQ ID NO: 1393529 - DNA, 22 bp, Artificial Sequence
  chemically synthesized
ttaagaataacacctctgaagt

SEQ ID NO: 1393530 - DNA, 22 bp, Artificial Sequence
  chemically synthesized
agaataacacctctgaagtgat

SEQ ID NO: 1393531 - DNA, 22 bp, Artificial Sequence
  chemically synthesized
gatctcaggaagtatcacttca

SEQ ID NO: 1393532 - DNA, 22 bp, Artificial Sequence
  chemically synthesized
tgaagtgatacttcctgagatc

SEQ ID NO: 1393533 - DNA, 22 bp, Artificial Sequence
  chemically synthesized
aagtgatacttcctgagatcca

SEQ ID NO: 1393534 - DNA, 22 bp, Artificial Sequence
  chemically synthesized
aaacagtaagtgtattggatct

SEQ ID NO: 1393535 - DNA, 22 bp, Artificial Sequence
  chemically synthesized
tctaaaacagtaagtgtattgg

SEQ ID NO: 1393536 - DNA, 22 bp, Artificial Sequence
  chemically synthesized
cctgagatccaatacacttact

SEQ ID NO: 1393537 - DNA, 22 bp, Artificial Sequence
  chemically synthesized
ctgagatccaatacacttactg

SEQ ID NO: 1393538 - DNA, 22 bp, Artificial Sequence
  chemically synthesized
agatccaatacacttactgttt

SEQ ID NO: 1393539 - DNA, 22 bp, Artificial Sequence
  chemically synthesized
cagcgtaagttatctaaaacag

SEQ ID NO: 1393540 - DNA, 22 bp, Artificial Sequence
  chemically synthesized
actgttttagataacttacgct

SEQ ID NO: 1393541 - DNA, 22 bp, Artificial Sequence
  chemically synthesized
ctgttttagataacttacgctg

SEQ ID NO: 1393542 - DNA, 22 bp, Artificial Sequence
  chemically synthesized
ttttagataacttacgctgtag

SEQ ID NO: 1393543 - DNA, 22 bp, Artificial Sequence
  chemically synthesized
cagagatgaaaactacagcgta

SEQ ID NO: 1393544 - DNA, 22 bp, Artificial Sequence
  chemically synthesized
tagataacttacgctgtagttt

SEQ ID NO: 1393545 - DNA, 22 bp, Artificial Sequence
  chemically synthesized
agataacttacgctgtagtttt

SEQ ID NO: 1393546 - DNA, 22 bp, Artificial Sequence
  chemically synthesized
gataacttacgctgtagttttc

SEQ ID NO: 1393547 - DNA, 22 bp, Artificial Sequence
  chemically synthesized
atctacagagatgaaaactaca

SEQ ID NO: 1393548 - DNA, 22 bp, Artificial Sequence
  chemically synthesized
acgctgtagttttcatctctgt

SEQ ID NO: 1393549 - DNA, 22 bp, Artificial Sequence
  chemically synthesized
cgctgtagttttcatctctgta

SEQ ID NO: 1393550 - DNA, 22 bp, Artificial Sequence
  chemically synthesized
tagttttcatctctgtagatga

SEQ ID NO: 1393551 - DNA, 22 bp, Artificial Sequence
  chemically synthesized
gtgtatcccacctcatctacag

SEQ ID NO: 1393552 - DNA, 22 bp, Artificial Sequence
  chemically synthesized
tcatctctgtagatgaggtggg

SEQ ID NO: 1393553 - DNA, 22 bp, Artificial Sequence
  chemically synthesized
catctctgtagatgaggtggga

SEQ ID NO: 1393554 - DNA, 22 bp, Artificial Sequence
  chemically synthesized
atctctgtagatgaggtgggat

SEQ ID NO: 1393555 - DNA, 22 bp, Artificial Sequence
  chemically synthesized
tgtagatgaggtgggatacact

SEQ ID NO: 1393556 - DNA, 22 bp, Artificial Sequence
  chemically synthesized
ataagtaggtattagtgtatcc

SEQ ID NO: 1393557 - DNA, 22 bp, Artificial Sequence
  chemically synthesized
tagatgaggtgggatacactaa

SEQ ID NO: 1393558 - DNA, 22 bp, Artificial Sequence
  chemically synthesized
gataagtaggtattagtgtatc

SEQ ID NO: 1393559 - DNA, 22 bp, Artificial Sequence
  chemically synthesized
cttgataagtaggtattagtgt

SEQ ID NO: 1393560 - DNA, 22 bp, Artificial Sequence
  chemically synthesized
tcagactgcttgataagtaggt

SEQ ID NO: 1393561 - DNA, 22 bp, Artificial Sequence
  chemically synthesized
gtcagactgcttgataagtagg

SEQ ID NO: 1393562 - DNA, 22 bp, Artificial Sequence
  chemically synthesized
aaacttgtcagactgcttgata

SEQ ID NO: 1393563 - DNA, 22 bp, Artificial Sequence
  chemically synthesized
aaaacttgtcagactgcttgat

SEQ ID NO: 1393564 - DNA, 22 bp, Artificial Sequence
  chemically synthesized
atacctacttatcaagcagtct

SEQ ID NO: 1393565 - DNA, 22 bp, Artificial Sequence
  chemically synthesized
ttaaaacttgtcagactgcttg

SEQ ID NO: 1393566 - DNA, 22 bp, Artificial Sequence
  chemically synthesized
cttatcaagcagtctgacaagt

SEQ ID NO: 1393567 - DNA, 22 bp, Artificial Sequence
  chemically synthesized
atcaagcagtctgacaagtttt

SEQ ID NO: 1393568 - DNA, 22 bp, Artificial Sequence
  chemically synthesized
tcaagcagtctgacaagtttta

SEQ ID NO: 1393569 - DNA, 22 bp, Artificial Sequence
  chemically synthesized
gacataataattcttaaaactt

SEQ ID NO: 1393570 - DNA, 22 bp, Artificial Sequence
  chemically synthesized
ggacataataattcttaaaact

SEQ ID NO: 1393571 - DNA, 22 bp, Artificial Sequence
  chemically synthesized
atttggacataataattcttaa

SEQ ID NO: 1393572 - DNA, 22 bp, Artificial Sequence
  chemically synthesized
aatttggacataataattctta

SEQ ID NO: 1393573 - DNA, 22 bp, Artificial Sequence
  chemically synthesized
acaagttttaagaattattatg

SEQ ID NO: 1393574 - DNA, 22 bp, Artificial Sequence
  chemically synthesized
aatttaatttggacataataat

SEQ ID NO: 1393575 - DNA, 22 bp, Artificial Sequence
  chemically synthesized
aaatttaatttggacataataa

SEQ ID NO: 1393576 - DNA, 22 bp, Artificial Sequence
  chemically synthesized
gtttaaatttaatttggacata

SEQ ID NO: 1393577 - DNA, 22 bp, Artificial Sequence
  chemically synthesized
ggtttaaatttaatttggacat

SEQ ID NO: 1393578 - DNA, 22 bp, Artificial Sequence
  chemically synthesized
taagaattattatgtccaaatt

SEQ ID NO: 1393579 - DNA, 22 bp, Artificial Sequence
  chemically synthesized
aagaattattatgtccaaatta

SEQ ID NO: 1393580 - DNA, 22 bp, Artificial Sequence
  chemically synthesized
agaattattatgtccaaattaa

SEQ ID NO: 1393581 - DNA, 22 bp, Artificial Sequence
  chemically synthesized
atttggtttaaatttaatttgg

SEQ ID NO: 1393582 - DNA, 22 bp, Artificial Sequence
  chemically synthesized
ttaatttggtttaaatttaatt

SEQ ID NO: 1393583 - DNA, 22 bp, Artificial Sequence
  chemically synthesized
ttatgtccaaattaaatttaaa

SEQ ID NO: 1393584 - DNA, 22 bp, Artificial Sequence
  chemically synthesized
tgtccaaattaaatttaaacca

SEQ ID NO: 1393585 - DNA, 22 bp, Artificial Sequence
  chemically synthesized
gcatatactattaatttggttt

SEQ ID NO: 1393586 - DNA, 22 bp, Artificial Sequence
  chemically synthesized
ggcatatactattaatttggtt

SEQ ID NO: 1393587 - DNA, 22 bp, Artificial Sequence
  chemically synthesized
aatttaaaccaaattaatagta

SEQ ID NO: 1393588 - DNA, 22 bp, Artificial Sequence
  chemically synthesized
acaatttggcatatactattaa

SEQ ID NO: 1393589 - DNA, 22 bp, Artificial Sequence
  chemically synthesized
aaaccaaattaatagtatatgc

SEQ ID NO: 1393590 - DNA, 22 bp, Artificial Sequence
  chemically synthesized
aaccaaattaatagtatatgcc

SEQ ID NO: 1393591 - DNA, 22 bp, Artificial Sequence
  chemically synthesized
atagtatatgccaaattgtgaa

SEQ ID NO: 1393592 - DNA, 22 bp, Artificial Sequence
  chemically synthesized
atgtgtgtgtgtacattcacaa

SEQ ID NO: 1393593 - DNA, 22 bp, Artificial Sequence
  chemically synthesized
tgtacactaatgtgtgtgtgta

SEQ ID NO: 1393594 - DNA, 22 bp, Artificial Sequence
  chemically synthesized
tgaatgtacacacacacattag

SEQ ID NO: 1393595 - DNA, 22 bp, Artificial Sequence
  chemically synthesized
gaaaaaaagataattatgtaca

SEQ ID NO: 1393596 - DNA, 22 bp, Artificial Sequence
  chemically synthesized
ggaaaaaaagataattatgtac

SEQ ID NO: 1393597 - DNA, 22 bp, Artificial Sequence
  chemically synthesized
tggaaaaaaagataattatgta

SEQ ID NO: 1393598 - DNA, 22 bp, Artificial Sequence
  chemically synthesized
ttggaaaaaaagataattatgt

SEQ ID NO: 1393599 - DNA, 22 bp, Artificial Sequence
  chemically synthesized
aatatttttggaaaaaaagata

SEQ ID NO: 1393600 - DNA, 22 bp, Artificial Sequence
  chemically synthesized
gtgtacataattatcttttttt

SEQ ID NO: 1393601 - DNA, 22 bp, Artificial Sequence
  chemically synthesized
aaatatttttggaaaaaaagat

SEQ ID NO: 1393602 - DNA, 22 bp, Artificial Sequence
  chemically synthesized
cttaaatatttttggaaaaaaa

SEQ ID NO: 1393603 - DNA, 22 bp, Artificial Sequence
  chemically synthesized
acttaaatatttttggaaaaaa

SEQ ID NO: 1393604 - DNA, 22 bp, Artificial Sequence
  chemically synthesized
tacttaaatatttttggaaaaa

SEQ ID NO: 1393605 - DNA, 22 bp, Artificial Sequence
  chemically synthesized
ttacttaaatatttttggaaaa

SEQ ID NO: 1393606 - DNA, 22 bp, Artificial Sequence
  chemically synthesized
ttttacttaaatatttttggaa

SEQ ID NO: 1393607 - DNA, 22 bp, Artificial Sequence
  chemically synthesized
tctttttttccaaaaatattta

SEQ ID NO: 1393608 - DNA, 22 bp, Artificial Sequence
  chemically synthesized
tgttcttttacttaaatatttt

SEQ ID NO: 1393609 - DNA, 22 bp, Artificial Sequence
  chemically synthesized
atgttcttttacttaaatattt

SEQ ID NO: 1393610 - DNA, 22 bp, Artificial Sequence
  chemically synthesized
tatgttcttttacttaaatatt

SEQ ID NO: 1393611 - DNA, 22 bp, Artificial Sequence
  chemically synthesized
tttttccaaaaatatttaagta

SEQ ID NO: 1393612 - DNA, 22 bp, Artificial Sequence
  chemically synthesized
ttttccaaaaatatttaagtaa

SEQ ID NO: 1393613 - DNA, 22 bp, Artificial Sequence
  chemically synthesized
tttccaaaaatatttaagtaaa

SEQ ID NO: 1393614 - DNA, 22 bp, Artificial Sequence
  chemically synthesized
ttccaaaaatatttaagtaaaa

SEQ ID NO: 1393615 - DNA, 22 bp, Artificial Sequence
  chemically synthesized
aactttatgttcttttacttaa

SEQ ID NO: 1393616 - DNA, 22 bp, Artificial Sequence
  chemically synthesized
tccaaaaatatttaagtaaaag

SEQ ID NO: 1393617 - DNA, 22 bp, Artificial Sequence
  chemically synthesized
aaactttatgttcttttactta

SEQ ID NO: 1393618 - DNA, 22 bp, Artificial Sequence
  chemically synthesized
ccaaaaatatttaagtaaaaga

SEQ ID NO: 1393619 - DNA, 22 bp, Artificial Sequence
  chemically synthesized
taaactttatgttcttttactt

SEQ ID NO: 1393620 - DNA, 22 bp, Artificial Sequence
  chemically synthesized
caaaaatatttaagtaaaagaa

SEQ ID NO: 1393621 - DNA, 22 bp, Artificial Sequence
  chemically synthesized
ttaaactttatgttcttttact

SEQ ID NO: 1393622 - DNA, 22 bp, Artificial Sequence
  chemically synthesized
tttttaaactttatgttctttt

SEQ ID NO: 1393623 - DNA, 22 bp, Artificial Sequence
  chemically synthesized
aagtaaaagaacataaagttta

SEQ ID NO: 1393624 - DNA, 22 bp, Artificial Sequence
  chemically synthesized
agtaaaagaacataaagtttaa

SEQ ID NO: 1393625 - DNA, 22 bp, Artificial Sequence
  chemically synthesized
tcaaagtctatttttaaacttt

SEQ ID NO: 1393626 - DNA, 22 bp, Artificial Sequence
  chemically synthesized
ctatcaaagtctatttttaaac

SEQ ID NO: 1393627 - DNA, 22 bp, Artificial Sequence
  chemically synthesized
tctactatcaaagtctattttt

SEQ ID NO: 1393628 - DNA, 22 bp, Artificial Sequence
  chemically synthesized
aaaaatagactttgatagtaga

SEQ ID NO: 1393629 - DNA, 22 bp, Artificial Sequence
  chemically synthesized
aaaatagactttgatagtagac

SEQ ID NO: 1393630 - DNA, 22 bp, Artificial Sequence
  chemically synthesized
atcaaaaaaaaagtctgtctac

SEQ ID NO: 1393631 - DNA, 22 bp, Artificial Sequence
  chemically synthesized
tgatagtagacagacttttttt

SEQ ID NO: 1393632 - DNA, 22 bp, Artificial Sequence
  chemically synthesized
ccaattcatcaaaaaaaaagtc

SEQ ID NO: 1393633 - DNA, 22 bp, Artificial Sequence
  chemically synthesized
gatagtagacagactttttttt

SEQ ID NO: 1393634 - DNA, 22 bp, Artificial Sequence
  chemically synthesized
atagtagacagacttttttttt

SEQ ID NO: 1393635 - DNA, 22 bp, Artificial Sequence
  chemically synthesized
tttttttgatgaattggtaata

SEQ ID NO: 1393636 - DNA, 22 bp, Artificial Sequence
  chemically synthesized
ttttttgatgaattggtaatat

SEQ ID NO: 1393637 - DNA, 22 bp, Artificial Sequence
  chemically synthesized
tttttgatgaattggtaatatt

SEQ ID NO: 1393638 - DNA, 22 bp, Artificial Sequence
  chemically synthesized
ttttgatgaattggtaatattc

SEQ ID NO: 1393639 - DNA, 22 bp, Artificial Sequence
  chemically synthesized
tagaacaagaatgaatattacc

SEQ ID NO: 1393640 - DNA, 22 bp, Artificial Sequence
  chemically synthesized
tttgatgaattggtaatattca

SEQ ID NO: 1393641 - DNA, 22 bp, Artificial Sequence
  chemically synthesized
ttgatgaattggtaatattcat

SEQ ID NO: 1393642 - DNA, 22 bp, Artificial Sequence
  chemically synthesized
tgatgaattggtaatattcatt

SEQ ID NO: 1393643 - DNA, 22 bp, Artificial Sequence
  chemically synthesized
gatgaattggtaatattcattc

SEQ ID NO: 1393644 - DNA, 22 bp, Artificial Sequence
  chemically synthesized
atgaattggtaatattcattct

SEQ ID NO: 1393645 - DNA, 22 bp, Artificial Sequence
  chemically synthesized
aaattatagaacaagaatgaat

SEQ ID NO: 1393646 - DNA, 22 bp, Artificial Sequence
  chemically synthesized
aaaattatagaacaagaatgaa

SEQ ID NO: 1393647 - DNA, 22 bp, Artificial Sequence
  chemically synthesized
tttaaaattatagaacaagaat

SEQ ID NO: 1393648 - DNA, 22 bp, Artificial Sequence
  chemically synthesized
atttaaaattatagaacaagaa

SEQ ID NO: 1393649 - DNA, 22 bp, Artificial Sequence
  chemically synthesized
tatttaaaattatagaacaaga

SEQ ID NO: 1393650 - DNA, 22 bp, Artificial Sequence
  chemically synthesized
gtaatattcattcttgttctat

SEQ ID NO: 1393651 - DNA, 22 bp, Artificial Sequence
  chemically synthesized
ttatttaaaattatagaacaag

SEQ ID NO: 1393652 - DNA, 22 bp, Artificial Sequence
  chemically synthesized
tttatttaaaattatagaacaa

SEQ ID NO: 1393653 - DNA, 22 bp, Artificial Sequence
  chemically synthesized
attcttgttctataattttaaa

SEQ ID NO: 1393654 - DNA, 22 bp, Artificial Sequence
  chemically synthesized
ttgttctataattttaaataaa

SEQ ID NO: 1393655 - DNA, 22 bp, Artificial Sequence
  chemically synthesized
gttctataattttaaataaaaa

SEQ ID NO: 1393656 - DNA, 22 bp, Artificial Sequence
  chemically synthesized
ttctataattttaaataaaaag

SEQ ID NO: 1393657 - DNA, 22 bp, Artificial Sequence
  chemically synthesized
tataattttaaataaaaagttt

SEQ ID NO: 1393658 - DNA, 22 bp, Artificial Sequence
  chemically synthesized
taattttaaataaaaagtttgt

SEQ ID NO: 1393659 - DNA, 22 bp, Artificial Sequence
  chemically synthesized
aagatacaatgagacaaacttt

SEQ ID NO: 1393660 - DNA, 22 bp, Artificial Sequence
  chemically synthesized
aaagatacaatgagacaaactt

SEQ ID NO: 1393661 - DNA, 22 bp, Artificial Sequence
  chemically synthesized
taaagatacaatgagacaaact

SEQ ID NO: 1393662 - DNA, 22 bp, Artificial Sequence
  chemically synthesized
ttaaagatacaatgagacaaac

SEQ ID NO: 1393663 - DNA, 22 bp, Artificial Sequence
  chemically synthesized
taaataaaaagtttgtctcatt

SEQ ID NO: 1393664 - DNA, 22 bp, Artificial Sequence
  chemically synthesized
aaataaaaagtttgtctcattg

SEQ ID NO: 1393665 - DNA, 22 bp, Artificial Sequence
  chemically synthesized
aataaaaagtttgtctcattgt

SEQ ID NO: 1393666 - DNA, 22 bp, Artificial Sequence
  chemically synthesized
accaacacgtatttttaaagat

SEQ ID NO: 1393667 - DNA, 22 bp, Artificial Sequence
  chemically synthesized
gtctcattgtatctttaaaaat

SEQ ID NO: 1393668 - DNA, 22 bp, Artificial Sequence
  chemically synthesized
tctcattgtatctttaaaaata

SEQ ID NO: 1393669 - DNA, 22 bp, Artificial Sequence
  chemically synthesized
attgtatctttaaaaatacgtg

SEQ ID NO: 1393670 - DNA, 22 bp, Artificial Sequence
  chemically synthesized
caaatcctcaccaacacgtatt

SEQ ID NO: 1393671 - DNA, 22 bp, Artificial Sequence
  chemically synthesized
tatctttaaaaatacgtgttgg

SEQ ID NO: 1393672 - DNA, 22 bp, Artificial Sequence
  chemically synthesized
tccaaatcctcaccaacacgta

SEQ ID NO: 1393673 - DNA, 22 bp, Artificial Sequence
  chemically synthesized
ctccaaatcctcaccaacacgt

SEQ ID NO: 1393674 - DNA, 22 bp, Artificial Sequence
  chemically synthesized
tctccaaatcctcaccaacacg

SEQ ID NO: 1393675 - DNA, 22 bp, Artificial Sequence
  chemically synthesized
ttctccaaatcctcaccaacac

SEQ ID NO: 1393676 - DNA, 22 bp, Artificial Sequence
  chemically synthesized
taaaaatacgtgttggtgagga

SEQ ID NO: 1393677 - DNA, 22 bp, Artificial Sequence
  chemically synthesized
cttttctccaaatcctcaccaa

SEQ ID NO: 1393678 - DNA, 22 bp, Artificial Sequence
  chemically synthesized
aaaaatacgtgttggtgaggat

SEQ ID NO: 1393679 - DNA, 22 bp, Artificial Sequence
  chemically synthesized
ccttttctccaaatcctcacca

SEQ ID NO: 1393680 - DNA, 22 bp, Artificial Sequence
  chemically synthesized
aaaatacgtgttggtgaggatt

SEQ ID NO: 1393681 - DNA, 22 bp, Artificial Sequence
  chemically synthesized
gtgaggatttggagaaaaggaa

SEQ ID NO: 1393682 - DNA, 22 bp, Artificial Sequence
  chemically synthesized
ccacaaacagtgcatgagggtt

SEQ ID NO: 1393683 - DNA, 22 bp, Artificial Sequence
  chemically synthesized
ggagaaaaggaaaccctcatgc

SEQ ID NO: 1393684 - DNA, 22 bp, Artificial Sequence
  chemically synthesized
gagaaaaggaaaccctcatgca

SEQ ID NO: 1393685 - DNA, 22 bp, Artificial Sequence
  chemically synthesized
cattcccacaaacagtgcatga

SEQ ID NO: 1393686 - DNA, 22 bp, Artificial Sequence
  chemically synthesized
acattcccacaaacagtgcatg

SEQ ID NO: 1393687 - DNA, 22 bp, Artificial Sequence
  chemically synthesized
taccaatttacattcccacaaa

SEQ ID NO: 1393688 - DNA, 22 bp, Artificial Sequence
  chemically synthesized
atgcactgtttgtgggaatgta

SEQ ID NO: 1393689 - DNA, 22 bp, Artificial Sequence
  chemically synthesized
taatggctgtaccaatttacat

SEQ ID NO: 1393690 - DNA, 22 bp, Artificial Sequence
  chemically synthesized
gtaatggctgtaccaatttaca

SEQ ID NO: 1393691 - DNA, 22 bp, Artificial Sequence
  chemically synthesized
tgtaatggctgtaccaatttac

SEQ ID NO: 1393692 - DNA, 22 bp, Artificial Sequence
  chemically synthesized
tttgtgggaatgtaaattggta

SEQ ID NO: 1393693 - DNA, 22 bp, Artificial Sequence
  chemically synthesized
ttgtaatggctgtaccaattta

SEQ ID NO: 1393694 - DNA, 22 bp, Artificial Sequence
  chemically synthesized
tttgtaatggctgtaccaattt

SEQ ID NO: 1393695 - DNA, 22 bp, Artificial Sequence
  chemically synthesized
ttttgtaatggctgtaccaatt

SEQ ID NO: 1393696 - DNA, 22 bp, Artificial Sequence
  chemically synthesized
gtgggaatgtaaattggtacag

SEQ ID NO: 1393697 - DNA, 22 bp, Artificial Sequence
  chemically synthesized
tttttgtaatggctgtaccaat

SEQ ID NO: 1393698 - DNA, 22 bp, Artificial Sequence
  chemically synthesized
tgggaatgtaaattggtacagc

SEQ ID NO: 1393699 - DNA, 22 bp, Artificial Sequence
  chemically synthesized
ttttttttgtaatggctgtacc

SEQ ID NO: 1393700 - DNA, 22 bp, Artificial Sequence
  chemically synthesized
ctattttttttgtaatggctgt

SEQ ID NO: 1393701 - DNA, 22 bp, Artificial Sequence
  chemically synthesized
cctactattttttttgtaatgg

SEQ ID NO: 1393702 - DNA, 22 bp, Artificial Sequence
  chemically synthesized
gtacagccattacaaaaaaaat

SEQ ID NO: 1393703 - DNA, 22 bp, Artificial Sequence
  chemically synthesized
agaaacctccctactatttttt

SEQ ID NO: 1393704 - DNA, 22 bp, Artificial Sequence
  chemically synthesized
gagaaacctccctactattttt

SEQ ID NO: 1393705 - DNA, 22 bp, Artificial Sequence
  chemically synthesized
atagtttgagaaacctccctac

SEQ ID NO: 1393706 - DNA, 22 bp, Artificial Sequence
  chemically synthesized
caaaaaaaatagtagggaggtt

SEQ ID NO: 1393707 - DNA, 22 bp, Artificial Sequence
  chemically synthesized
aatagtttgagaaacctcccta

SEQ ID NO: 1393708 - DNA, 22 bp, Artificial Sequence
  chemically synthesized
taatagtttgagaaacctccct

SEQ ID NO: 1393709 - DNA, 22 bp, Artificial Sequence
  chemically synthesized
ttaatagtttgagaaacctccc

SEQ ID NO: 1393710 - DNA, 22 bp, Artificial Sequence
  chemically synthesized
tttttaatagtttgagaaacct

SEQ ID NO: 1393711 - DNA, 22 bp, Artificial Sequence
  chemically synthesized
tatttttaatagtttgagaaac

SEQ ID NO: 1393712 - DNA, 22 bp, Artificial Sequence
  chemically synthesized
atggtaattctatttttaatag

SEQ ID NO: 1393713 - DNA, 22 bp, Artificial Sequence
  chemically synthesized
ctcaaactattaaaaatagaat

SEQ ID NO: 1393714 - DNA, 22 bp, Artificial Sequence
  chemically synthesized
gatctcatggtaattctatttt

SEQ ID NO: 1393715 - DNA, 22 bp, Artificial Sequence
  chemically synthesized
tcaaactattaaaaatagaatt

SEQ ID NO: 1393716 - DNA, 22 bp, Artificial Sequence
  chemically synthesized
aaactattaaaaatagaattac

SEQ ID NO: 1393717 - DNA, 22 bp, Artificial Sequence
  chemically synthesized
ctagatctcatggtaattctat

SEQ ID NO: 1393718 - DNA, 22 bp, Artificial Sequence
  chemically synthesized
ttaaaaatagaattaccatgag

SEQ ID NO: 1393719 - DNA, 22 bp, Artificial Sequence
  chemically synthesized
aaaatagaattaccatgagatc

SEQ ID NO: 1393720 - DNA, 22 bp, Artificial Sequence
  chemically synthesized
ccatgagatctagcaatttcac

SEQ ID NO: 1393721 - DNA, 22 bp, Artificial Sequence
  chemically synthesized
aggtaaataatcaacagtgaaa

SEQ ID NO: 1393722 - DNA, 22 bp, Artificial Sequence
  chemically synthesized
caggtaaataatcaacagtgaa

SEQ ID NO: 1393723 - DNA, 22 bp, Artificial Sequence
  chemically synthesized
ttcaggtaaataatcaacagtg

SEQ ID NO: 1393724 - DNA, 22 bp, Artificial Sequence
  chemically synthesized
gcaatttcactgttgattattt

SEQ ID NO: 1393725 - DNA, 22 bp, Artificial Sequence
  chemically synthesized
atgttcttcaggtaaataatca

SEQ ID NO: 1393726 - DNA, 22 bp, Artificial Sequence
  chemically synthesized
catgttcttcaggtaaataatc

SEQ ID NO: 1393727 - DNA, 22 bp, Artificial Sequence
  chemically synthesized
atttcatgttcttcaggtaaat

SEQ ID NO: 1393728 - DNA, 22 bp, Artificial Sequence
  chemically synthesized
cactgttgattatttacctgaa

SEQ ID NO: 1393729 - DNA, 22 bp, Artificial Sequence
  chemically synthesized
actgttgattatttacctgaag

SEQ ID NO: 1393730 - DNA, 22 bp, Artificial Sequence
  chemically synthesized
ttgattatttacctgaagaaca

SEQ ID NO: 1393731 - DNA, 22 bp, Artificial Sequence
  chemically synthesized
agatactaatttcatgttcttc

SEQ ID NO: 1393732 - DNA, 22 bp, Artificial Sequence
  chemically synthesized
attatttacctgaagaacatga

SEQ ID NO: 1393733 - DNA, 22 bp, Artificial Sequence
  chemically synthesized
gagatactaatttcatgttctt

SEQ ID NO: 1393734 - DNA, 22 bp, Artificial Sequence
  chemically synthesized
tgagatactaatttcatgttct

SEQ ID NO: 1393735 - DNA, 22 bp, Artificial Sequence
  chemically synthesized
ttgagatactaatttcatgttc

SEQ ID NO: 1393736 - DNA, 22 bp, Artificial Sequence
  chemically synthesized
tttacctgaagaacatgaaatt

SEQ ID NO: 1393737 - DNA, 22 bp, Artificial Sequence
  chemically synthesized
acctgaagaacatgaaattagt

SEQ ID NO: 1393738 - DNA, 22 bp, Artificial Sequence
  chemically synthesized
cctgaagaacatgaaattagta

SEQ ID NO: 1393739 - DNA, 22 bp, Artificial Sequence
  chemically synthesized
aagaacatgaaattagtatctc

SEQ ID NO: 1393740 - DNA, 22 bp, Artificial Sequence
  chemically synthesized
gtatctcaaaaatatatctgta

SEQ ID NO: 1393741 - DNA, 22 bp, Artificial Sequence
  chemically synthesized
aaaaatatatctgtactctgac

SEQ ID NO: 1393742 - DNA, 22 bp, Artificial Sequence
  chemically synthesized
tgaataatgcagcaataaatgt

SEQ ID NO: 1393743 - DNA, 22 bp, Artificial Sequence
  chemically synthesized
ttgtgaataatgcagcaataaa

SEQ ID NO: 1393744 - DNA, 22 bp, Artificial Sequence
  chemically synthesized
tactctgacatttattgctgca

SEQ ID NO: 1393745 - DNA, 22 bp, Artificial Sequence
  chemically synthesized
gctattgtgaataatgcagcaa

SEQ ID NO: 1393746 - DNA, 22 bp, Artificial Sequence
  chemically synthesized
ggctattgtgaataatgcagca

SEQ ID NO: 1393747 - DNA, 22 bp, Artificial Sequence
  chemically synthesized
tgacatttattgctgcattatt

SEQ ID NO: 1393748 - DNA, 22 bp, Artificial Sequence
  chemically synthesized
acatttattgctgcattattca

SEQ ID NO: 1393749 - DNA, 22 bp, Artificial Sequence
  chemically synthesized
tatcttggctattgtgaataat

SEQ ID NO: 1393750 - DNA, 22 bp, Artificial Sequence
  chemically synthesized
attgctgcattattcacaatag

SEQ ID NO: 1393751 - DNA, 22 bp, Artificial Sequence
  chemically synthesized
ttgctgcattattcacaatagc

SEQ ID NO: 1393752 - DNA, 22 bp, Artificial Sequence
  chemically synthesized
tggctatatcttggctattgtg

SEQ ID NO: 1393753 - DNA, 22 bp, Artificial Sequence
  chemically synthesized
ctgcattattcacaatagccaa

SEQ ID NO: 1393754 - DNA, 22 bp, Artificial Sequence
  chemically synthesized
cattattcacaatagccaagat

SEQ ID NO: 1393755 - DNA, 22 bp, Artificial Sequence
  chemically synthesized
ttcacaatagccaagatatagc

SEQ ID NO: 1393756 - DNA, 22 bp, Artificial Sequence
  chemically synthesized
acaatagccaagatatagccac

SEQ ID NO: 1393757 - DNA, 22 bp, Artificial Sequence
  chemically synthesized
atccatacatccacaaacacag

SEQ ID NO: 1393758 - DNA, 22 bp, Artificial Sequence
  chemically synthesized
ttcatccatacatccacaaaca

SEQ ID NO: 1393759 - DNA, 22 bp, Artificial Sequence
  chemically synthesized
attcatccatacatccacaaac

SEQ ID NO: 1393760 - DNA, 22 bp, Artificial Sequence
  chemically synthesized
tattcatccatacatccacaaa

SEQ ID NO: 1393761 - DNA, 22 bp, Artificial Sequence
  chemically synthesized
tttattcatccatacatccaca

SEQ ID NO: 1393762 - DNA, 22 bp, Artificial Sequence
  chemically synthesized
ctttattcatccatacatccac

SEQ ID NO: 1393763 - DNA, 22 bp, Artificial Sequence
  chemically synthesized
tgtttgtggatgtatggatgaa

SEQ ID NO: 1393764 - DNA, 22 bp, Artificial Sequence
  chemically synthesized
gtggatgtatggatgaataaag

SEQ ID NO: 1393765 - DNA, 22 bp, Artificial Sequence
  chemically synthesized
tggatgtatggatgaataaaga

SEQ ID NO: 1393766 - DNA, 22 bp, Artificial Sequence
  chemically synthesized
tatacataccataatttcttta

SEQ ID NO: 1393767 - DNA, 22 bp, Artificial Sequence
  chemically synthesized
attgtatacataccataatttc

SEQ ID NO: 1393768 - DNA, 22 bp, Artificial Sequence
  chemically synthesized
cattgtatacataccataattt

SEQ ID NO: 1393769 - DNA, 22 bp, Artificial Sequence
  chemically synthesized
aataatatttcattgtatacat

SEQ ID NO: 1393770 - DNA, 22 bp, Artificial Sequence
  chemically synthesized
tggctgaataatatttcattgt

SEQ ID NO: 1393771 - DNA, 22 bp, Artificial Sequence
  chemically synthesized
atggctgaataatatttcattg

SEQ ID NO: 1393772 - DNA, 22 bp, Artificial Sequence
  chemically synthesized
tggtatgtatacaatgaaatat

SEQ ID NO: 1393773 - DNA, 22 bp, Artificial Sequence
  chemically synthesized
tatggctgaataatatttcatt

SEQ ID NO: 1393774 - DNA, 22 bp, Artificial Sequence
  chemically synthesized
ttatggctgaataatatttcat

SEQ ID NO: 1393775 - DNA, 22 bp, Artificial Sequence
  chemically synthesized
tttatggctgaataatatttca

SEQ ID NO: 1393776 - DNA, 22 bp, Artificial Sequence
  chemically synthesized
tttttatggctgaataatattt

SEQ ID NO: 1393777 - DNA, 22 bp, Artificial Sequence
  chemically synthesized
ctttttatggctgaataatatt

SEQ ID NO: 1393778 - DNA, 22 bp, Artificial Sequence
  chemically synthesized
cttctttttatggctgaataat

SEQ ID NO: 1393779 - DNA, 22 bp, Artificial Sequence
  chemically synthesized
ccttctttttatggctgaataa

SEQ ID NO: 1393780 - DNA, 22 bp, Artificial Sequence
  chemically synthesized
ttcagccataaaaagaaggaaa

SEQ ID NO: 1393781 - DNA, 22 bp, Artificial Sequence
  chemically synthesized
caaatcgcaagatttccttctt

SEQ ID NO: 1393782 - DNA, 22 bp, Artificial Sequence
  chemically synthesized
agccataaaaagaaggaaatct

SEQ ID NO: 1393783 - DNA, 22 bp, Artificial Sequence
  chemically synthesized
ttgcaaatcgcaagatttcctt

SEQ ID NO: 1393784 - DNA, 22 bp, Artificial Sequence
  chemically synthesized
gttgcaaatcgcaagatttcct

SEQ ID NO: 1393785 - DNA, 22 bp, Artificial Sequence
  chemically synthesized
accttgttgcaaatcgcaagat

SEQ ID NO: 1393786 - DNA, 22 bp, Artificial Sequence
  chemically synthesized
caagttcaccttgttgcaaatc

SEQ ID NO: 1393787 - DNA, 22 bp, Artificial Sequence
  chemically synthesized
gcgatttgcaacaaggtgaact

SEQ ID NO: 1393788 - DNA, 22 bp, Artificial Sequence
  chemically synthesized
cgatttgcaacaaggtgaactt

SEQ ID NO: 1393789 - DNA, 22 bp, Artificial Sequence
  chemically synthesized
gcaacaaggtgaacttggagga

SEQ ID NO: 1393790 - DNA, 22 bp, Artificial Sequence
  chemically synthesized
acatagcatatgtcctccaagt

SEQ ID NO: 1393791 - DNA, 22 bp, Artificial Sequence
  chemically synthesized
caacaaggtgaacttggaggac

SEQ ID NO: 1393792 - DNA, 22 bp, Artificial Sequence
  chemically synthesized
cacatagcatatgtcctccaag

SEQ ID NO: 1393793 - DNA, 22 bp, Artificial Sequence
  chemically synthesized
tttcacatagcatatgtcctcc

SEQ ID NO: 1393794 - DNA, 22 bp, Artificial Sequence
  chemically synthesized
atttcacatagcatatgtcctc

SEQ ID NO: 1393795 - DNA, 22 bp, Artificial Sequence
  chemically synthesized
cccttatttcacatagcatatg

SEQ ID NO: 1393796 - DNA, 22 bp, Artificial Sequence
  chemically synthesized
tgcccttatttcacatagcata

SEQ ID NO: 1393797 - DNA, 22 bp, Artificial Sequence
  chemically synthesized
ctgcccttatttcacatagcat

SEQ ID NO: 1393798 - DNA, 22 bp, Artificial Sequence
  chemically synthesized
tctgcccttatttcacatagca

SEQ ID NO: 1393799 - DNA, 22 bp, Artificial Sequence
  chemically synthesized
ttctgcccttatttcacatagc

SEQ ID NO: 1393800 - DNA, 22 bp, Artificial Sequence
  chemically synthesized
ggaggacatatgctatgtgaaa

SEQ ID NO: 1393801 - DNA, 22 bp, Artificial Sequence
  chemically synthesized
tttctgcccttatttcacatag

SEQ ID NO: 1393802 - DNA, 22 bp, Artificial Sequence
  chemically synthesized
gaggacatatgctatgtgaaat

SEQ ID NO: 1393803 - DNA, 22 bp, Artificial Sequence
  chemically synthesized
ttttctgcccttatttcacata

SEQ ID NO: 1393804 - DNA, 22 bp, Artificial Sequence
  chemically synthesized
atttttttctgcccttatttca

SEQ ID NO: 1393805 - DNA, 22 bp, Artificial Sequence
  chemically synthesized
catttttttctgcccttatttc

SEQ ID NO: 1393806 - DNA, 22 bp, Artificial Sequence
  chemically synthesized
tcatttttttctgcccttattt

SEQ ID NO: 1393807 - DNA, 22 bp, Artificial Sequence
  chemically synthesized
tctttcatttttttctgccctt

SEQ ID NO: 1393808 - DNA, 22 bp, Artificial Sequence
  chemically synthesized
gtctttcatttttttctgccct

SEQ ID NO: 1393809 - DNA, 22 bp, Artificial Sequence
  chemically synthesized
tgtgaaataagggcagaaaaaa

SEQ ID NO: 1393810 - DNA, 22 bp, Artificial Sequence
  chemically synthesized
cacacataatatcatgcaacat

SEQ ID NO: 1393811 - DNA, 22 bp, Artificial Sequence
  chemically synthesized
tattccacacataatatcatgc

SEQ ID NO: 1393812 - DNA, 22 bp, Artificial Sequence
  chemically synthesized
atattccacacataatatcatg

SEQ ID NO: 1393813 - DNA, 22 bp, Artificial Sequence
  chemically synthesized
tatattccacacataatatcat

SEQ ID NO: 1393814 - DNA, 22 bp, Artificial Sequence
  chemically synthesized
aacattttatattccacacata

SEQ ID NO: 1393815 - DNA, 22 bp, Artificial Sequence
  chemically synthesized
catgatattatgtgtggaatat

SEQ ID NO: 1393816 - DNA, 22 bp, Artificial Sequence
  chemically synthesized
taagttcaacattttatattcc

SEQ ID NO: 1393817 - DNA, 22 bp, Artificial Sequence
  chemically synthesized
tataagttcaacattttatatt

SEQ ID NO: 1393818 - DNA, 22 bp, Artificial Sequence
  chemically synthesized
ctataagttcaacattttatat

SEQ ID NO: 1393819 - DNA, 22 bp, Artificial Sequence
  chemically synthesized
cttctataagttcaacatttta

SEQ ID NO: 1393820 - DNA, 22 bp, Artificial Sequence
  chemically synthesized
tgtgtggaatataaaatgttga

SEQ ID NO: 1393821 - DNA, 22 bp, Artificial Sequence
  chemically synthesized
cctacttctataagttcaacat

SEQ ID NO: 1393822 - DNA, 22 bp, Artificial Sequence
  chemically synthesized
ctccctacttctataagttcaa

SEQ ID NO: 1393823 - DNA, 22 bp, Artificial Sequence
  chemically synthesized
tactccctacttctataagttc

SEQ ID NO: 1393824 - DNA, 22 bp, Artificial Sequence
  chemically synthesized
ttctactccctacttctataag

SEQ ID NO: 1393825 - DNA, 22 bp, Artificial Sequence
  chemically synthesized
aacttatagaagtagggagtag

SEQ ID NO: 1393826 - DNA, 22 bp, Artificial Sequence
  chemically synthesized
gcaaccgctattctactcccta

SEQ ID NO: 1393827 - DNA, 22 bp, Artificial Sequence
  chemically synthesized
ctggcaaccgctattctactcc

SEQ ID NO: 1393828 - DNA, 22 bp, Artificial Sequence
  chemically synthesized
atagaagtagggagtagaatag

SEQ ID NO: 1393829 - DNA, 22 bp, Artificial Sequence
  chemically synthesized
tagaagtagggagtagaatagc

SEQ ID NO: 1393830 - DNA, 22 bp, Artificial Sequence
  chemically synthesized
taccactcctggcaaccgctat

SEQ ID NO: 1393831 - DNA, 22 bp, Artificial Sequence
  chemically synthesized
ataccactcctggcaaccgcta

SEQ ID NO: 1393832 - DNA, 22 bp, Artificial Sequence
  chemically synthesized
cccatttataccactcctggca

SEQ ID NO: 1393833 - DNA, 22 bp, Artificial Sequence
  chemically synthesized
accaacaactccccatttatac

SEQ ID NO: 1393834 - DNA, 22 bp, Artificial Sequence
  chemically synthesized
tgaccaacaactccccatttat

SEQ ID NO: 1393835 - DNA, 22 bp, Artificial Sequence
  chemically synthesized
ccaggagtggtataaatgggga

SEQ ID NO: 1393836 - DNA, 22 bp, Artificial Sequence
  chemically synthesized
tctgaccaacaactccccattt

SEQ ID NO: 1393837 - DNA, 22 bp, Artificial Sequence
  chemically synthesized
ctctctgaccaacaactcccca

SEQ ID NO: 1393838 - DNA, 22 bp, Artificial Sequence
  chemically synthesized
ctactctctgaccaacaactcc

SEQ ID NO: 1393839 - DNA, 22 bp, Artificial Sequence
  chemically synthesized
aaggttcctactctctgaccaa

SEQ ID NO: 1393840 - DNA, 22 bp, Artificial Sequence
  chemically synthesized
taactgaaggttcctactctct

SEQ ID NO: 1393841 - DNA, 22 bp, Artificial Sequence
  chemically synthesized
tataactgaaggttcctactct

SEQ ID NO: 1393842 - DNA, 22 bp, Artificial Sequence
  chemically synthesized
ttggtcagagagtaggaacctt

SEQ ID NO: 1393843 - DNA, 22 bp, Artificial Sequence
  chemically synthesized
gatctctataactgaaggttcc

SEQ ID NO: 1393844 - DNA, 22 bp, Artificial Sequence
  chemically synthesized
gtcagagagtaggaaccttcag

SEQ ID NO: 1393845 - DNA, 22 bp, Artificial Sequence
  chemically synthesized
tacgttagatctctataactga

SEQ ID NO: 1393846 - DNA, 22 bp, Artificial Sequence
  chemically synthesized
ccatgctgtacgttagatctct

SEQ ID NO: 1393847 - DNA, 22 bp, Artificial Sequence
  chemically synthesized
cagttatagagatctaacgtac

SEQ ID NO: 1393848 - DNA, 22 bp, Artificial Sequence
  chemically synthesized
agttatagagatctaacgtaca

SEQ ID NO: 1393849 - DNA, 22 bp, Artificial Sequence
  chemically synthesized
cagttaccatgctgtacgttag

SEQ ID NO: 1393850 - DNA, 22 bp, Artificial Sequence
  chemically synthesized
actacagttaccatgctgtacg

SEQ ID NO: 1393851 - DNA, 22 bp, Artificial Sequence
  chemically synthesized
tagagatctaacgtacagcatg

SEQ ID NO: 1393852 - DNA, 22 bp, Artificial Sequence
  chemically synthesized
atattaactacagttaccatgc

SEQ ID NO: 1393853 - DNA, 22 bp, Artificial Sequence
  chemically synthesized
acgtacagcatggtaactgtag

SEQ ID NO: 1393854 - DNA, 22 bp, Artificial Sequence
  chemically synthesized
aagtataaaggacattaatatt

SEQ ID NO: 1393855 - DNA, 22 bp, Artificial Sequence
  chemically synthesized
caagtataaaggacattaatat

SEQ ID NO: 1393856 - DNA, 22 bp, Artificial Sequence
  chemically synthesized
tagttaatattaatgtccttta

SEQ ID NO: 1393857 - DNA, 22 bp, Artificial Sequence
  chemically synthesized
agcaagtttcaagtataaagga

SEQ ID NO: 1393858 - DNA, 22 bp, Artificial Sequence
  chemically synthesized
atattaatgtcctttatacttg

SEQ ID NO: 1393859 - DNA, 22 bp, Artificial Sequence
  chemically synthesized
cctcagcaagtttcaagtataa

SEQ ID NO: 1393860 - DNA, 22 bp, Artificial Sequence
  chemically synthesized
ctccctcagcaagtttcaagta

SEQ ID NO: 1393861 - DNA, 22 bp, Artificial Sequence
  chemically synthesized
atgtcctttatacttgaaactt

SEQ ID NO: 1393862 - DNA, 22 bp, Artificial Sequence
  chemically synthesized
tgatctactccctcagcaagtt

SEQ ID NO: 1393863 - DNA, 22 bp, Artificial Sequence
  chemically synthesized
atgatctactccctcagcaagt

SEQ ID NO: 1393864 - DNA, 22 bp, Artificial Sequence
  chemically synthesized
tatacttgaaacttgctgaggg

SEQ ID NO: 1393865 - DNA, 22 bp, Artificial Sequence
  chemically synthesized
atacttgaaacttgctgaggga

SEQ ID NO: 1393866 - DNA, 22 bp, Artificial Sequence
  chemically synthesized
tacttgaaacttgctgagggag

SEQ ID NO: 1393867 - DNA, 22 bp, Artificial Sequence
  chemically synthesized
gaaacttgctgagggagtagat

SEQ ID NO: 1393868 - DNA, 22 bp, Artificial Sequence
  chemically synthesized
aaacttgctgagggagtagatc

SEQ ID NO: 1393869 - DNA, 22 bp, Artificial Sequence
  chemically synthesized
tgatgagaacacttatgatcta

SEQ ID NO: 1393870 - DNA, 22 bp, Artificial Sequence
  chemically synthesized
gtgatgagaacacttatgatct

SEQ ID NO: 1393871 - DNA, 22 bp, Artificial Sequence
  chemically synthesized
gctgagggagtagatcataagt

SEQ ID NO: 1393872 - DNA, 22 bp, Artificial Sequence
  chemically synthesized
tgtgatgagaacacttatgatc

SEQ ID NO: 1393873 - DNA, 22 bp, Artificial Sequence
  chemically synthesized
ctgagggagtagatcataagtg

SEQ ID NO: 1393874 - DNA, 22 bp, Artificial Sequence
  chemically synthesized
ttgtgatgagaacacttatgat

SEQ ID NO: 1393875 - DNA, 22 bp, Artificial Sequence
  chemically synthesized
tttgtgatgagaacacttatga

SEQ ID NO: 1393876 - DNA, 22 bp, Artificial Sequence
  chemically synthesized
ttttgtgatgagaacacttatg

SEQ ID NO: 1393877 - DNA, 22 bp, Artificial Sequence
  chemically synthesized
agggagtagatcataagtgttc

SEQ ID NO: 1393878 - DNA, 22 bp, Artificial Sequence
  chemically synthesized
tttttgtgatgagaacacttat

SEQ ID NO: 1393879 - DNA, 22 bp, Artificial Sequence
  chemically synthesized
ttttttgtgatgagaacactta

SEQ ID NO: 1393880 - DNA, 22 bp, Artificial Sequence
  chemically synthesized
ttttttttgtgatgagaacact

SEQ ID NO: 1393881 - DNA, 22 bp, Artificial Sequence
  chemically synthesized
tcatcacaaaaaaaagagacta

SEQ ID NO: 1393882 - DNA, 22 bp, Artificial Sequence
  chemically synthesized
atcacaaaaaaaagagactact

SEQ ID NO: 1393883 - DNA, 22 bp, Artificial Sequence
  chemically synthesized
acatatccatcaccgggcatag

SEQ ID NO: 1393884 - DNA, 22 bp, Artificial Sequence
  chemically synthesized
atataattaacatatccatcac

SEQ ID NO: 1393885 - DNA, 22 bp, Artificial Sequence
  chemically synthesized
gatataattaacatatccatca

SEQ ID NO: 1393886 - DNA, 22 bp, Artificial Sequence
  chemically synthesized
tgatataattaacatatccatc

SEQ ID NO: 1393887 - DNA, 22 bp, Artificial Sequence
  chemically synthesized
ctatgcccggtgatggatatgt

SEQ ID NO: 1393888 - DNA, 22 bp, Artificial Sequence
  chemically synthesized
tgcccggtgatggatatgttaa

SEQ ID NO: 1393889 - DNA, 22 bp, Artificial Sequence
  chemically synthesized
agatatacaacacggtattttg

SEQ ID NO: 1393890 - DNA, 22 bp, Artificial Sequence
  chemically synthesized
aagatatacaacacggtatttt

SEQ ID NO: 1393891 - DNA, 22 bp, Artificial Sequence
  chemically synthesized
attatatcaaaataccgtgttg

SEQ ID NO: 1393892 - DNA, 22 bp, Artificial Sequence
  chemically synthesized
tatatttaagatatacaacacg

SEQ ID NO: 1393893 - DNA, 22 bp, Artificial Sequence
  chemically synthesized
tatcaaaataccgtgttgtata

SEQ ID NO: 1393894 - DNA, 22 bp, Artificial Sequence
  chemically synthesized
tatatatttaagatatacaaca

SEQ ID NO: 1393895 - DNA, 22 bp, Artificial Sequence
  chemically synthesized
agaaataaaaacattctatata

SEQ ID NO: 1393896 - DNA, 22 bp, Artificial Sequence
  chemically synthesized
tatatcttaaatatatagaatg

SEQ ID NO: 1393897 - DNA, 22 bp, Artificial Sequence
  chemically synthesized
ttgagaaataaaaacattctat

SEQ ID NO: 1393898 - DNA, 22 bp, Artificial Sequence
  chemically synthesized
aaatatatagaatgtttttatt

SEQ ID NO: 1393899 - DNA, 22 bp, Artificial Sequence
  chemically synthesized
aatatatagaatgtttttattt

SEQ ID NO: 1393900 - DNA, 22 bp, Artificial Sequence
  chemically synthesized
tggaggtattattgagaaataa

SEQ ID NO: 1393901 - DNA, 22 bp, Artificial Sequence
  chemically synthesized
atggaggtattattgagaaata

SEQ ID NO: 1393902 - DNA, 22 bp, Artificial Sequence
  chemically synthesized
tatggaggtattattgagaaat

SEQ ID NO: 1393903 - DNA, 22 bp, Artificial Sequence
  chemically synthesized
ttatggaggtattattgagaaa

SEQ ID NO: 1393904 - DNA, 22 bp, Artificial Sequence
  chemically synthesized
atttttatggaggtattattga

SEQ ID NO: 1393905 - DNA, 22 bp, Artificial Sequence
  chemically synthesized
ttaatttttatggaggtattat

SEQ ID NO: 1393906 - DNA, 22 bp, Artificial Sequence
  chemically synthesized
ttatttctcaataatacctcca

SEQ ID NO: 1393907 - DNA, 22 bp, Artificial Sequence
  chemically synthesized
tatttctcaataatacctccat

SEQ ID NO: 1393908 - DNA, 22 bp, Artificial Sequence
  chemically synthesized
ttgttaatttttatggaggtat

SEQ ID NO: 1393909 - DNA, 22 bp, Artificial Sequence
  chemically synthesized
atttctcaataatacctccata

SEQ ID NO: 1393910 - DNA, 22 bp, Artificial Sequence
  chemically synthesized
gttgttaatttttatggaggta

SEQ ID NO: 1393911 - DNA, 22 bp, Artificial Sequence
  chemically synthesized
tttctcaataatacctccataa

SEQ ID NO: 1393912 - DNA, 22 bp, Artificial Sequence
  chemically synthesized
tgttgttaatttttatggaggt

SEQ ID NO: 1393913 - DNA, 22 bp, Artificial Sequence
  chemically synthesized
ttgttgttaatttttatggagg

SEQ ID NO: 1393914 - DNA, 22 bp, Artificial Sequence
  chemically synthesized
tttgttgttaatttttatggag

SEQ ID NO: 1393915 - DNA, 22 bp, Artificial Sequence
  chemically synthesized
ctcaataatacctccataaaaa

SEQ ID NO: 1393916 - DNA, 22 bp, Artificial Sequence
  chemically synthesized
ttttgttgttaatttttatgga

SEQ ID NO: 1393917 - DNA, 22 bp, Artificial Sequence
  chemically synthesized
tcaataatacctccataaaaat

SEQ ID NO: 1393918 - DNA, 22 bp, Artificial Sequence
  chemically synthesized
aataatacctccataaaaatta

SEQ ID NO: 1393919 - DNA, 22 bp, Artificial Sequence
  chemically synthesized
gggatacttttttgttgttaat

SEQ ID NO: 1393920 - DNA, 22 bp, Artificial Sequence
  chemically synthesized
agggatacttttttgttgttaa

SEQ ID NO: 1393921 - DNA, 22 bp, Artificial Sequence
  chemically synthesized
cataaaaattaacaacaaaaaa

SEQ ID NO: 1393922 - DNA, 22 bp, Artificial Sequence
  chemically synthesized
aaatcatttagggatacttttt

SEQ ID NO: 1393923 - DNA, 22 bp, Artificial Sequence
  chemically synthesized
ttgaaatcatttagggatactt

SEQ ID NO: 1393924 - DNA, 22 bp, Artificial Sequence
  chemically synthesized
acaacaaaaaagtatccctaaa

SEQ ID NO: 1393925 - DNA, 22 bp, Artificial Sequence
  chemically synthesized
taatgatatgttattgaaatca

SEQ ID NO: 1393926 - DNA, 22 bp, Artificial Sequence
  chemically synthesized
ctgtaatgatatgttattgaaa

SEQ ID NO: 1393927 - DNA, 22 bp, Artificial Sequence
  chemically synthesized
tagctgctgtaatgatatgtta

SEQ ID NO: 1393928 - DNA, 22 bp, Artificial Sequence
  chemically synthesized
aatgatttcaataacatatcat

SEQ ID NO: 1393929 - DNA, 22 bp, Artificial Sequence
  chemically synthesized
gtagctgctgtaatgatatgtt

SEQ ID NO: 1393930 - DNA, 22 bp, Artificial Sequence
  chemically synthesized
tgtagctgctgtaatgatatgt

SEQ ID NO: 1393931 - DNA, 22 bp, Artificial Sequence
  chemically synthesized
ttgtagctgctgtaatgatatg

SEQ ID NO: 1393932 - DNA, 22 bp, Artificial Sequence
  chemically synthesized
tttgtagctgctgtaatgatat

SEQ ID NO: 1393933 - DNA, 22 bp, Artificial Sequence
  chemically synthesized
caataacatatcattacagcag

SEQ ID NO: 1393934 - DNA, 22 bp, Artificial Sequence
  chemically synthesized
tcctttttgtagctgctgtaat

SEQ ID NO: 1393935 - DNA, 22 bp, Artificial Sequence
  chemically synthesized
aataacatatcattacagcagc

SEQ ID NO: 1393936 - DNA, 22 bp, Artificial Sequence
  chemically synthesized
gtcctttttgtagctgctgtaa

SEQ ID NO: 1393937 - DNA, 22 bp, Artificial Sequence
  chemically synthesized
aatatcagtttgtcctttttgt

SEQ ID NO: 1393938 - DNA, 22 bp, Artificial Sequence
  chemically synthesized
cagcagctacaaaaaggacaaa

SEQ ID NO: 1393939 - DNA, 22 bp, Artificial Sequence
  chemically synthesized
tggctaaatatcagtttgtcct

SEQ ID NO: 1393940 - DNA, 22 bp, Artificial Sequence
  chemically synthesized
gtggctaaatatcagtttgtcc

SEQ ID NO: 1393941 - DNA, 22 bp, Artificial Sequence
  chemically synthesized
caaaaaggacaaactgatattt

SEQ ID NO: 1393942 - DNA, 22 bp, Artificial Sequence
  chemically synthesized
atcatcacatgcttgtggctaa

SEQ ID NO: 1393943 - DNA, 22 bp, Artificial Sequence
  chemically synthesized
atatttagccacaagcatgtga

SEQ ID NO: 1393944 - DNA, 22 bp, Artificial Sequence
  chemically synthesized
agccacaagcatgtgatgatca

SEQ ID NO: 1393945 - DNA, 22 bp, Artificial Sequence
  chemically synthesized
gccacaagcatgtgatgatcaa

SEQ ID NO: 1393946 - DNA, 22 bp, Artificial Sequence
  chemically synthesized
atagtgaaaatcagttgatcat

SEQ ID NO: 1393947 - DNA, 22 bp, Artificial Sequence
  chemically synthesized
aatagtgaaaatcagttgatca

SEQ ID NO: 1393948 - DNA, 22 bp, Artificial Sequence
  chemically synthesized
cggtaagagaacagtaacttaa

SEQ ID NO: 1393949 - DNA, 22 bp, Artificial Sequence
  chemically synthesized
acggtaagagaacagtaactta

SEQ ID NO: 1393950 - DNA, 22 bp, Artificial Sequence
  chemically synthesized
attttcactattaagttactgt

SEQ ID NO: 1393951 - DNA, 22 bp, Artificial Sequence
  chemically synthesized
ttacggtaagagaacagtaact

SEQ ID NO: 1393952 - DNA, 22 bp, Artificial Sequence
  chemically synthesized
tcactattaagttactgttctc

SEQ ID NO: 1393953 - DNA, 22 bp, Artificial Sequence
  chemically synthesized
ctcttacggtaagagaacagta

SEQ ID NO: 1393954 - DNA, 22 bp, Artificial Sequence
  chemically synthesized
cactattaagttactgttctct

SEQ ID NO: 1393955 - DNA, 22 bp, Artificial Sequence
  chemically synthesized
cctcttacggtaagagaacagt

SEQ ID NO: 1393956 - DNA, 22 bp, Artificial Sequence
  chemically synthesized
actattaagttactgttctctt

SEQ ID NO: 1393957 - DNA, 22 bp, Artificial Sequence
  chemically synthesized
tcctcttacggtaagagaacag

SEQ ID NO: 1393958 - DNA, 22 bp, Artificial Sequence
  chemically synthesized
ttttcctcttacggtaagagaa

SEQ ID NO: 1393959 - DNA, 22 bp, Artificial Sequence
  chemically synthesized
ttaagttactgttctcttaccg

SEQ ID NO: 1393960 - DNA, 22 bp, Artificial Sequence
  chemically synthesized
agttactgttctcttaccgtaa

SEQ ID NO: 1393961 - DNA, 22 bp, Artificial Sequence
  chemically synthesized
ctgttctcttaccgtaagagga

SEQ ID NO: 1393962 - DNA, 22 bp, Artificial Sequence
  chemically synthesized
ttctcttaccgtaagaggaaaa

SEQ ID NO: 1393963 - DNA, 22 bp, Artificial Sequence
  chemically synthesized
tcttaccgtaagaggaaaatag

SEQ ID NO: 1393964 - DNA, 22 bp, Artificial Sequence
  chemically synthesized
aaacatgaaggaactattttcc

SEQ ID NO: 1393965 - DNA, 22 bp, Artificial Sequence
  chemically synthesized
ttaccgtaagaggaaaatagtt

SEQ ID NO: 1393966 - DNA, 22 bp, Artificial Sequence
  chemically synthesized
accgtaagaggaaaatagttcc

SEQ ID NO: 1393967 - DNA, 22 bp, Artificial Sequence
  chemically synthesized
ttaaaacatgaaggaactattt

SEQ ID NO: 1393968 - DNA, 22 bp, Artificial Sequence
  chemically synthesized
ccgtaagaggaaaatagttcct

SEQ ID NO: 1393969 - DNA, 22 bp, Artificial Sequence
  chemically synthesized
gatgaaatgggattattaaaac

SEQ ID NO: 1393970 - DNA, 22 bp, Artificial Sequence
  chemically synthesized
tggatgaaatgggattattaaa

SEQ ID NO: 1393971 - DNA, 22 bp, Artificial Sequence
  chemically synthesized
ctggatgaaatgggattattaa

SEQ ID NO: 1393972 - DNA, 22 bp, Artificial Sequence
  chemically synthesized
cttcatgttttaataatcccat

SEQ ID NO: 1393973 - DNA, 22 bp, Artificial Sequence
  chemically synthesized
tgtttctggatgaaatgggatt

SEQ ID NO: 1393974 - DNA, 22 bp, Artificial Sequence
  chemically synthesized
catgttttaataatcccatttc

SEQ ID NO: 1393975 - DNA, 22 bp, Artificial Sequence
  chemically synthesized
atgttttaataatcccatttca

SEQ ID NO: 1393976 - DNA, 22 bp, Artificial Sequence
  chemically synthesized
tgtgtttctggatgaaatggga

SEQ ID NO: 1393977 - DNA, 22 bp, Artificial Sequence
  chemically synthesized
tctctgtgtttctggatgaaat

SEQ ID NO: 1393978 - DNA, 22 bp, Artificial Sequence
  chemically synthesized
taataatcccatttcatccaga

SEQ ID NO: 1393979 - DNA, 22 bp, Artificial Sequence
  chemically synthesized
aataatcccatttcatccagaa

SEQ ID NO: 1393980 - DNA, 22 bp, Artificial Sequence
  chemically synthesized
ataatcccatttcatccagaaa

SEQ ID NO: 1393981 - DNA, 22 bp, Artificial Sequence
  chemically synthesized
acacagggaattatctctgtgt

SEQ ID NO: 1393982 - DNA, 22 bp, Artificial Sequence
  chemically synthesized
catccagaaacacagagataat

SEQ ID NO: 1393983 - DNA, 22 bp, Artificial Sequence
  chemically synthesized
atccagaaacacagagataatt

SEQ ID NO: 1393984 - DNA, 22 bp, Artificial Sequence
  chemically synthesized
agatatgtgcggctaacacagg

SEQ ID NO: 1393985 - DNA, 22 bp, Artificial Sequence
  chemically synthesized
agtaagaattgagatatgtgcg

SEQ ID NO: 1393986 - DNA, 22 bp, Artificial Sequence
  chemically synthesized
cctgtgttagccgcacatatct

SEQ ID NO: 1393987 - DNA, 22 bp, Artificial Sequence
  chemically synthesized
gagtaagaattgagatatgtgc

SEQ ID NO: 1393988 - DNA, 22 bp, Artificial Sequence
  chemically synthesized
tgagtaagaattgagatatgtg

SEQ ID NO: 1393989 - DNA, 22 bp, Artificial Sequence
  chemically synthesized
tgttagccgcacatatctcaat

SEQ ID NO: 1393990 - DNA, 22 bp, Artificial Sequence
  chemically synthesized
aattttgagtaagaattgagat

SEQ ID NO: 1393991 - DNA, 22 bp, Artificial Sequence
  chemically synthesized
gccgcacatatctcaattctta

SEQ ID NO: 1393992 - DNA, 22 bp, Artificial Sequence
  chemically synthesized
attaaattttgagtaagaattg

SEQ ID NO: 1393993 - DNA, 22 bp, Artificial Sequence
  chemically synthesized
aagattaattaaattttgagta

SEQ ID NO: 1393994 - DNA, 22 bp, Artificial Sequence
  chemically synthesized
aattcttactcaaaatttaatt

SEQ ID NO: 1393995 - DNA, 22 bp, Artificial Sequence
  chemically synthesized
catcactgaagattaattaaat

SEQ ID NO: 1393996 - DNA, 22 bp, Artificial Sequence
  chemically synthesized
ccatcactgaagattaattaaa

SEQ ID NO: 1393997 - DNA, 22 bp, Artificial Sequence
  chemically synthesized
tccatcactgaagattaattaa

SEQ ID NO: 1393998 - DNA, 22 bp, Artificial Sequence
  chemically synthesized
ttactcaaaatttaattaatct

SEQ ID NO: 1393999 - DNA, 22 bp, Artificial Sequence
  chemically synthesized
actcaaaatttaattaatcttc

SEQ ID NO: 1394000 - DNA, 22 bp, Artificial Sequence
  chemically synthesized
ttttccatcactgaagattaat

SEQ ID NO: 1394001 - DNA, 22 bp, Artificial Sequence
  chemically synthesized
ctcaaaatttaattaatcttca

SEQ ID NO: 1394002 - DNA, 22 bp, Artificial Sequence
  chemically synthesized
aaaatttaattaatcttcagtg

SEQ ID NO: 1394003 - DNA, 22 bp, Artificial Sequence
  chemically synthesized
aattaatcttcagtgatggaaa

SEQ ID NO: 1394004 - DNA, 22 bp, Artificial Sequence
  chemically synthesized
attaatcttcagtgatggaaaa

SEQ ID NO: 1394005 - DNA, 22 bp, Artificial Sequence
  chemically synthesized
atagaaggaaattgttttccat

SEQ ID NO: 1394006 - DNA, 22 bp, Artificial Sequence
  chemically synthesized
aatagaaggaaattgttttcca

SEQ ID NO: 1394007 - DNA, 22 bp, Artificial Sequence
  chemically synthesized
atcttcagtgatggaaaacaat

SEQ ID NO: 1394008 - DNA, 22 bp, Artificial Sequence
  chemically synthesized
cagtgatggaaaacaatttcct

SEQ ID NO: 1394009 - DNA, 22 bp, Artificial Sequence
  chemically synthesized
agtgatggaaaacaatttcctt

SEQ ID NO: 1394010 - DNA, 22 bp, Artificial Sequence
  chemically synthesized
agcaatgatatggtcttaatag

SEQ ID NO: 1394011 - DNA, 22 bp, Artificial Sequence
  chemically synthesized
ccttctattaagaccatatcat

SEQ ID NO: 1394012 - DNA, 22 bp, Artificial Sequence
  chemically synthesized
cttctattaagaccatatcatt

SEQ ID NO: 1394013 - DNA, 22 bp, Artificial Sequence
  chemically synthesized
aagacgttcagcaatgatatgg

SEQ ID NO: 1394014 - DNA, 22 bp, Artificial Sequence
  chemically synthesized
ctattaagaccatatcattgct

SEQ ID NO: 1394015 - DNA, 22 bp, Artificial Sequence
  chemically synthesized
tattaagaccatatcattgctg

SEQ ID NO: 1394016 - DNA, 22 bp, Artificial Sequence
  chemically synthesized
ttaagaccatatcattgctgaa

SEQ ID NO: 1394017 - DNA, 22 bp, Artificial Sequence
  chemically synthesized
aaattaaagacgttcagcaatg

SEQ ID NO: 1394018 - DNA, 22 bp, Artificial Sequence
  chemically synthesized
gaaattaaagacgttcagcaat

SEQ ID NO: 1394019 - DNA, 22 bp, Artificial Sequence
  chemically synthesized
agaccatatcattgctgaacgt

SEQ ID NO: 1394020 - DNA, 22 bp, Artificial Sequence
  chemically synthesized
ttgaaattaaagacgttcagca

SEQ ID NO: 1394021 - DNA, 22 bp, Artificial Sequence
  chemically synthesized
atggttcttgaaattaaagacg

SEQ ID NO: 1394022 - DNA, 22 bp, Artificial Sequence
  chemically synthesized
ttaatggttcttgaaattaaag

SEQ ID NO: 1394023 - DNA, 22 bp, Artificial Sequence
  chemically synthesized
gttaatggttcttgaaattaaa

SEQ ID NO: 1394024 - DNA, 22 bp, Artificial Sequence
  chemically synthesized
tgttaatggttcttgaaattaa

SEQ ID NO: 1394025 - DNA, 22 bp, Artificial Sequence
  chemically synthesized
ctgaacgtctttaatttcaaga

SEQ ID NO: 1394026 - DNA, 22 bp, Artificial Sequence
  chemically synthesized
aacgtctttaatttcaagaacc

SEQ ID NO: 1394027 - DNA, 22 bp, Artificial Sequence
  chemically synthesized
aaattttgttaatggttcttga

SEQ ID NO: 1394028 - DNA, 22 bp, Artificial Sequence
  chemically synthesized
gaaattttgttaatggttcttg

SEQ ID NO: 1394029 - DNA, 22 bp, Artificial Sequence
  chemically synthesized
tttgaaattttgttaatggttc

SEQ ID NO: 1394030 - DNA, 22 bp, Artificial Sequence
  chemically synthesized
taatttcaagaaccattaacaa

SEQ ID NO: 1394031 - DNA, 22 bp, Artificial Sequence
  chemically synthesized
aatttcaagaaccattaacaaa

SEQ ID NO: 1394032 - DNA, 22 bp, Artificial Sequence
  chemically synthesized
atttcaagaaccattaacaaaa

SEQ ID NO: 1394033 - DNA, 22 bp, Artificial Sequence
  chemically synthesized
caagaaccattaacaaaatttc

SEQ ID NO: 1394034 - DNA, 22 bp, Artificial Sequence
  chemically synthesized
aagaaccattaacaaaatttca

SEQ ID NO: 1394035 - DNA, 22 bp, Artificial Sequence
  chemically synthesized
aataacataaattgtttgaaat

SEQ ID NO: 1394036 - DNA, 22 bp, Artificial Sequence
  chemically synthesized
aaataacataaattgtttgaaa

SEQ ID NO: 1394037 - DNA, 22 bp, Artificial Sequence
  chemically synthesized
taaataacataaattgtttgaa

SEQ ID NO: 1394038 - DNA, 22 bp, Artificial Sequence
  chemically synthesized
ttttaaataacataaattgttt

SEQ ID NO: 1394039 - DNA, 22 bp, Artificial Sequence
  chemically synthesized
acaaaatttcaaacaatttatg

SEQ ID NO: 1394040 - DNA, 22 bp, Artificial Sequence
  chemically synthesized
tattttaaataacataaattgt

SEQ ID NO: 1394041 - DNA, 22 bp, Artificial Sequence
  chemically synthesized
ctattttaaataacataaattg

SEQ ID NO: 1394042 - DNA, 22 bp, Artificial Sequence
  chemically synthesized
agcttctattttaaataacata

SEQ ID NO: 1394043 - DNA, 22 bp, Artificial Sequence
  chemically synthesized
cagcttctattttaaataacat

SEQ ID NO: 1394044 - DNA, 22 bp, Artificial Sequence
  chemically synthesized
tcagcttctattttaaataaca

SEQ ID NO: 1394045 - DNA, 22 bp, Artificial Sequence
  chemically synthesized
caaacaatttatgttatttaaa

SEQ ID NO: 1394046 - DNA, 22 bp, Artificial Sequence
  chemically synthesized
ttcagcttctattttaaataac

SEQ ID NO: 1394047 - DNA, 22 bp, Artificial Sequence
  chemically synthesized
aaacaatttatgttatttaaaa

SEQ ID NO: 1394048 - DNA, 22 bp, Artificial Sequence
  chemically synthesized
tttcagcttctattttaaataa

SEQ ID NO: 1394049 - DNA, 22 bp, Artificial Sequence
  chemically synthesized
ttttcagcttctattttaaata

SEQ ID NO: 1394050 - DNA, 22 bp, Artificial Sequence
  chemically synthesized
cttttttcagcttctattttaa

SEQ ID NO: 1394051 - DNA, 22 bp, Artificial Sequence
  chemically synthesized
tccttttttcagcttctatttt

SEQ ID NO: 1394052 - DNA, 22 bp, Artificial Sequence
  chemically synthesized
ctccttttttcagcttctattt

SEQ ID NO: 1394053 - DNA, 22 bp, Artificial Sequence
  chemically synthesized
tctccttttttcagcttctatt

SEQ ID NO: 1394054 - DNA, 22 bp, Artificial Sequence
  chemically synthesized
atgttatttaaaatagaagctg

SEQ ID NO: 1394055 - DNA, 22 bp, Artificial Sequence
  chemically synthesized
tgttatttaaaatagaagctga

SEQ ID NO: 1394056 - DNA, 22 bp, Artificial Sequence
  chemically synthesized
tttaaaatagaagctgaaaaaa

SEQ ID NO: 1394057 - DNA, 22 bp, Artificial Sequence
  chemically synthesized
tgtagttttctccttttttcag

SEQ ID NO: 1394058 - DNA, 22 bp, Artificial Sequence
  chemically synthesized
gtgtagttttctccttttttca

SEQ ID NO: 1394059 - DNA, 22 bp, Artificial Sequence
  chemically synthesized
aaaatagaagctgaaaaaagga

SEQ ID NO: 1394060 - DNA, 22 bp, Artificial Sequence
  chemically synthesized
aaatagaagctgaaaaaaggag

SEQ ID NO: 1394061 - DNA, 22 bp, Artificial Sequence
  chemically synthesized
aaaaaaggagaaaactacacaa

SEQ ID NO: 1394062 - DNA, 22 bp, Artificial Sequence
  chemically synthesized
tgatggtaaaatatttgtgtag

SEQ ID NO: 1394063 - DNA, 22 bp, Artificial Sequence
  chemically synthesized
ttgtgatggtaaaatatttgtg

SEQ ID NO: 1394064 - DNA, 22 bp, Artificial Sequence
  chemically synthesized
gttgtgatggtaaaatatttgt

SEQ ID NO: 1394065 - DNA, 22 bp, Artificial Sequence
  chemically synthesized
acatttgttgtgatggtaaaat

SEQ ID NO: 1394066 - DNA, 22 bp, Artificial Sequence
  chemically synthesized
cacaaatattttaccatcacaa

SEQ ID NO: 1394067 - DNA, 22 bp, Artificial Sequence
  chemically synthesized
tgattcacatttgttgtgatgg

SEQ ID NO: 1394068 - DNA, 22 bp, Artificial Sequence
  chemically synthesized
aatctgtgattcacatttgttg

SEQ ID NO: 1394069 - DNA, 22 bp, Artificial Sequence
  chemically synthesized
taccatcacaacaaatgtgaat

SEQ ID NO: 1394070 - DNA, 22 bp, Artificial Sequence
  chemically synthesized
accatcacaacaaatgtgaatc

SEQ ID NO: 1394071 - DNA, 22 bp, Artificial Sequence
  chemically synthesized
ccatcacaacaaatgtgaatca

SEQ ID NO: 1394072 - DNA, 22 bp, Artificial Sequence
  chemically synthesized
agaatcacatattgaatctgtg

SEQ ID NO: 1394073 - DNA, 22 bp, Artificial Sequence
  chemically synthesized
aagaatcacatattgaatctgt

SEQ ID NO: 1394074 - DNA, 22 bp, Artificial Sequence
  chemically synthesized
agaaatgtgtttaagaatcaca

SEQ ID NO: 1394075 - DNA, 22 bp, Artificial Sequence
  chemically synthesized
aagaaatgtgtttaagaatcac

SEQ ID NO: 1394076 - DNA, 22 bp, Artificial Sequence
  chemically synthesized
aatatgtgattcttaaacacat

SEQ ID NO: 1394077 - DNA, 22 bp, Artificial Sequence
  chemically synthesized
ttaaacacatttcttaaatatg

SEQ ID NO: 1394078 - DNA, 22 bp, Artificial Sequence
  chemically synthesized
aaacacatttcttaaatatgtt

SEQ ID NO: 1394079 - DNA, 22 bp, Artificial Sequence
  chemically synthesized
aacacatttcttaaatatgttt

SEQ ID NO: 1394080 - DNA, 22 bp, Artificial Sequence
  chemically synthesized
cagccaaaacagcaaacatatt

SEQ ID NO: 1394081 - DNA, 22 bp, Artificial Sequence
  chemically synthesized
gcagccaaaacagcaaacatat

SEQ ID NO: 1394082 - DNA, 22 bp, Artificial Sequence
  chemically synthesized
tgcagccaaaacagcaaacata

SEQ ID NO: 1394083 - DNA, 22 bp, Artificial Sequence
  chemically synthesized
ttttgcagccaaaacagcaaac

SEQ ID NO: 1394084 - DNA, 22 bp, Artificial Sequence
  chemically synthesized
cttaaatatgtttgctgttttg

SEQ ID NO: 1394085 - DNA, 22 bp, Artificial Sequence
  chemically synthesized
ttaaatatgtttgctgttttgg

SEQ ID NO: 1394086 - DNA, 22 bp, Artificial Sequence
  chemically synthesized
aaatatgtttgctgttttggct

SEQ ID NO: 1394087 - DNA, 22 bp, Artificial Sequence
  chemically synthesized
aatatgtttgctgttttggctg

SEQ ID NO: 1394088 - DNA, 22 bp, Artificial Sequence
  chemically synthesized
acgattgttttgcagccaaaac

SEQ ID NO: 1394089 - DNA, 22 bp, Artificial Sequence
  chemically synthesized
aacattgacgattgttttgcag

SEQ ID NO: 1394090 - DNA, 22 bp, Artificial Sequence
  chemically synthesized
gctgttttggctgcaaaacaat

SEQ ID NO: 1394091 - DNA, 22 bp, Artificial Sequence
  chemically synthesized
ctgttttggctgcaaaacaatc

SEQ ID NO: 1394092 - DNA, 22 bp, Artificial Sequence
  chemically synthesized
ttttggctgcaaaacaatcgtc

SEQ ID NO: 1394093 - DNA, 22 bp, Artificial Sequence
  chemically synthesized
tggctgcaaaacaatcgtcaat

SEQ ID NO: 1394094 - DNA, 22 bp, Artificial Sequence
  chemically synthesized
ggctgcaaaacaatcgtcaatg

SEQ ID NO: 1394095 - DNA, 22 bp, Artificial Sequence
  chemically synthesized
gctgcaaaacaatcgtcaatgt

SEQ ID NO: 1394096 - DNA, 22 bp, Artificial Sequence
  chemically synthesized
caaaacaatcgtcaatgttgag

SEQ ID NO: 1394097 - DNA, 22 bp, Artificial Sequence
  chemically synthesized
aagtgtccgatacgctcaacat

SEQ ID NO: 1394098 - DNA, 22 bp, Artificial Sequence
  chemically synthesized
ctaaagtgtccgatacgctcaa

SEQ ID NO: 1394099 - DNA, 22 bp, Artificial Sequence
  chemically synthesized
cctaaagtgtccgatacgctca

SEQ ID NO: 1394100 - DNA, 22 bp, Artificial Sequence
  chemically synthesized
tcctaaagtgtccgatacgctc

SEQ ID NO: 1394101 - DNA, 22 bp, Artificial Sequence
  chemically synthesized
aagattttcctaaagtgtccga

SEQ ID NO: 1394102 - DNA, 22 bp, Artificial Sequence
  chemically synthesized
ctaaagattttcctaaagtgtc

SEQ ID NO: 1394103 - DNA, 22 bp, Artificial Sequence
  chemically synthesized
agcgtatcggacactttaggaa

SEQ ID NO: 1394104 - DNA, 22 bp, Artificial Sequence
  chemically synthesized
ttactaaagattttcctaaagt

SEQ ID NO: 1394105 - DNA, 22 bp, Artificial Sequence
  chemically synthesized
ttattactaaagattttcctaa

SEQ ID NO: 1394106 - DNA, 22 bp, Artificial Sequence
  chemically synthesized
gttattactaaagattttccta

SEQ ID NO: 1394107 - DNA, 22 bp, Artificial Sequence
  chemically synthesized
taggaaaatctttagtaataac

SEQ ID NO: 1394108 - DNA, 22 bp, Artificial Sequence
  chemically synthesized
aggaaaatctttagtaataaca

SEQ ID NO: 1394109 - DNA, 22 bp, Artificial Sequence
  chemically synthesized
ggaaaatctttagtaataacaa

SEQ ID NO: 1394110 - DNA, 22 bp, Artificial Sequence
  chemically synthesized
agagaatagaatttgttattac

SEQ ID NO: 1394111 - DNA, 22 bp, Artificial Sequence
  chemically synthesized
tagtaataacaaattctattct

SEQ ID NO: 1394112 - DNA, 22 bp, Artificial Sequence
  chemically synthesized
agtaataacaaattctattctc

SEQ ID NO: 1394113 - DNA, 22 bp, Artificial Sequence
  chemically synthesized
gtaataacaaattctattctct

SEQ ID NO: 1394114 - DNA, 22 bp, Artificial Sequence
  chemically synthesized
tattctcttagtatcttatttc

SEQ ID NO: 1394115 - DNA, 22 bp, Artificial Sequence
  chemically synthesized
ttctcttagtatcttatttctt

SEQ ID NO: 1394116 - DNA, 22 bp, Artificial Sequence
  chemically synthesized
tcttagtatcttatttcttgct

SEQ ID NO: 1394117 - DNA, 22 bp, Artificial Sequence
  chemically synthesized
ttagtatcttatttcttgctga

SEQ ID NO: 1394118 - DNA, 22 bp, Artificial Sequence
  chemically synthesized
agtatcttatttcttgctgata

SEQ ID NO: 1394119 - DNA, 22 bp, Artificial Sequence
  chemically synthesized
gtatcttatttcttgctgatac

SEQ ID NO: 1394120 - DNA, 22 bp, Artificial Sequence
  chemically synthesized
ggataggcacagagtatcagca

SEQ ID NO: 1394121 - DNA, 22 bp, Artificial Sequence
  chemically synthesized
ttaggataggcacagagtatca

SEQ ID NO: 1394122 - DNA, 22 bp, Artificial Sequence
  chemically synthesized
attaggataggcacagagtatc

SEQ ID NO: 1394123 - DNA, 22 bp, Artificial Sequence
  chemically synthesized
atttcttgctgatactctgtgc

SEQ ID NO: 1394124 - DNA, 22 bp, Artificial Sequence
  chemically synthesized
tttcttgctgatactctgtgcc

SEQ ID NO: 1394125 - DNA, 22 bp, Artificial Sequence
  chemically synthesized
cttattaggataggcacagagt

SEQ ID NO: 1394126 - DNA, 22 bp, Artificial Sequence
  chemically synthesized
cttgctgatactctgtgcctat

SEQ ID NO: 1394127 - DNA, 22 bp, Artificial Sequence
  chemically synthesized
ttgctgatactctgtgcctatc

SEQ ID NO: 1394128 - DNA, 22 bp, Artificial Sequence
  chemically synthesized
gctgatactctgtgcctatcct

SEQ ID NO: 1394129 - DNA, 22 bp, Artificial Sequence
  chemically synthesized
ctgatactctgtgcctatccta

SEQ ID NO: 1394130 - DNA, 22 bp, Artificial Sequence
  chemically synthesized
atactctgtgcctatcctaata

SEQ ID NO: 1394131 - DNA, 22 bp, Artificial Sequence
  chemically synthesized
tgtgcctatcctaataagcagg

SEQ ID NO: 1394132 - DNA, 22 bp, Artificial Sequence
  chemically synthesized
tgcctatcctaataagcagggg

SEQ ID NO: 1394133 - DNA, 22 bp, Artificial Sequence
  chemically synthesized
cagtatgtagccatcccctgct

SEQ ID NO: 1394134 - DNA, 22 bp, Artificial Sequence
  chemically synthesized
tcctaataagcaggggatggct

SEQ ID NO: 1394135 - DNA, 22 bp, Artificial Sequence
  chemically synthesized
agtgattacagtatgtagccat

SEQ ID NO: 1394136 - DNA, 22 bp, Artificial Sequence
  chemically synthesized
ataagcaggggatggctacata

SEQ ID NO: 1394137 - DNA, 22 bp, Artificial Sequence
  chemically synthesized
ctgagtgattacagtatgtagc

SEQ ID NO: 1394138 - DNA, 22 bp, Artificial Sequence
  chemically synthesized
cctgagtgattacagtatgtag

SEQ ID NO: 1394139 - DNA, 22 bp, Artificial Sequence
  chemically synthesized
tcttcctgagtgattacagtat

SEQ ID NO: 1394140 - DNA, 22 bp, Artificial Sequence
  chemically synthesized
atcttcctgagtgattacagta

SEQ ID NO: 1394141 - DNA, 22 bp, Artificial Sequence
  chemically synthesized
tatcttcctgagtgattacagt

SEQ ID NO: 1394142 - DNA, 22 bp, Artificial Sequence
  chemically synthesized
ttttatcttcctgagtgattac

SEQ ID NO: 1394143 - DNA, 22 bp, Artificial Sequence
  chemically synthesized
gctgttttatcttcctgagtga

SEQ ID NO: 1394144 - DNA, 22 bp, Artificial Sequence
  chemically synthesized
catactgtaatcactcaggaag

SEQ ID NO: 1394145 - DNA, 22 bp, Artificial Sequence
  chemically synthesized
taatcactcaggaagataaaac

SEQ ID NO: 1394146 - DNA, 22 bp, Artificial Sequence
  chemically synthesized
aaaatgttggctgttttatctt

SEQ ID NO: 1394147 - DNA, 22 bp, Artificial Sequence
  chemically synthesized
aggaagataaaacagccaacat

SEQ ID NO: 1394148 - DNA, 22 bp, Artificial Sequence
  chemically synthesized
agaccaacaacactcaaaatgt

SEQ ID NO: 1394149 - DNA, 22 bp, Artificial Sequence
  chemically synthesized
ctgagaccaacaacactcaaaa

SEQ ID NO: 1394150 - DNA, 22 bp, Artificial Sequence
  chemically synthesized
cctgagaccaacaacactcaaa

SEQ ID NO: 1394151 - DNA, 22 bp, Artificial Sequence
  chemically synthesized
tcttcctgagaccaacaacact

SEQ ID NO: 1394152 - DNA, 22 bp, Artificial Sequence
  chemically synthesized
atcttcctgagaccaacaacac

SEQ ID NO: 1394153 - DNA, 22 bp, Artificial Sequence
  chemically synthesized
tatcttcctgagaccaacaaca

SEQ ID NO: 1394154 - DNA, 22 bp, Artificial Sequence
  chemically synthesized
ctttatcttcctgagaccaaca

SEQ ID NO: 1394155 - DNA, 22 bp, Artificial Sequence
  chemically synthesized
gctgctttatcttcctgagacc

SEQ ID NO: 1394156 - DNA, 22 bp, Artificial Sequence
  chemically synthesized
tgagtgttgttggtctcaggaa

SEQ ID NO: 1394157 - DNA, 22 bp, Artificial Sequence
  chemically synthesized
gagtgttgttggtctcaggaag

SEQ ID NO: 1394158 - DNA, 22 bp, Artificial Sequence
  chemically synthesized
agtgttgttggtctcaggaaga

SEQ ID NO: 1394159 - DNA, 22 bp, Artificial Sequence
  chemically synthesized
aaaagttggctgctttatcttc

SEQ ID NO: 1394160 - DNA, 22 bp, Artificial Sequence
  chemically synthesized
ttggtctcaggaagataaagca

SEQ ID NO: 1394161 - DNA, 22 bp, Artificial Sequence
  chemically synthesized
gtctcaggaagataaagcagcc

SEQ ID NO: 1394162 - DNA, 22 bp, Artificial Sequence
  chemically synthesized
aggaagataaagcagccaactt

SEQ ID NO: 1394163 - DNA, 22 bp, Artificial Sequence
  chemically synthesized
tcaaccaacaacactcaaaagt

SEQ ID NO: 1394164 - DNA, 22 bp, Artificial Sequence
  chemically synthesized
agacctatcaaccaacaacact

SEQ ID NO: 1394165 - DNA, 22 bp, Artificial Sequence
  chemically synthesized
tcagacctatcaaccaacaaca

SEQ ID NO: 1394166 - DNA, 22 bp, Artificial Sequence
  chemically synthesized
tctcagacctatcaaccaacaa

SEQ ID NO: 1394167 - DNA, 22 bp, Artificial Sequence
  chemically synthesized
ctctcagacctatcaaccaaca

SEQ ID NO: 1394168 - DNA, 22 bp, Artificial Sequence
  chemically synthesized
tctctcagacctatcaaccaac

SEQ ID NO: 1394169 - DNA, 22 bp, Artificial Sequence
  chemically synthesized
ttgagtgttgttggttgatagg

SEQ ID NO: 1394170 - DNA, 22 bp, Artificial Sequence
  chemically synthesized
ttttctctcagacctatcaacc

SEQ ID NO: 1394171 - DNA, 22 bp, Artificial Sequence
  chemically synthesized
tgagtgttgttggttgataggt

SEQ ID NO: 1394172 - DNA, 22 bp, Artificial Sequence
  chemically synthesized
gagtgttgttggttgataggtc

SEQ ID NO: 1394173 - DNA, 22 bp, Artificial Sequence
  chemically synthesized
tgttttctctcagacctatcaa

SEQ ID NO: 1394174 - DNA, 22 bp, Artificial Sequence
  chemically synthesized
agtgttgttggttgataggtct

SEQ ID NO: 1394175 - DNA, 22 bp, Artificial Sequence
  chemically synthesized
tgttctgttttctctcagacct

SEQ ID NO: 1394176 - DNA, 22 bp, Artificial Sequence
  chemically synthesized
ttggttgataggtctgagagaa

SEQ ID NO: 1394177 - DNA, 22 bp, Artificial Sequence
  chemically synthesized
ctgtgttctgttttctctcaga

SEQ ID NO: 1394178 - DNA, 22 bp, Artificial Sequence
  chemically synthesized
actgtgttctgttttctctcag

SEQ ID NO: 1394179 - DNA, 22 bp, Artificial Sequence
  chemically synthesized
tactgtgttctgttttctctca

SEQ ID NO: 1394180 - DNA, 22 bp, Artificial Sequence
  chemically synthesized
gttgataggtctgagagaaaac

SEQ ID NO: 1394181 - DNA, 22 bp, Artificial Sequence
  chemically synthesized
ataggtctgagagaaaacagaa

SEQ ID NO: 1394182 - DNA, 22 bp, Artificial Sequence
  chemically synthesized
aatgttttactgtgttctgttt

SEQ ID NO: 1394183 - DNA, 22 bp, Artificial Sequence
  chemically synthesized
agagaaaacagaacacagtaaa

SEQ ID NO: 1394184 - DNA, 22 bp, Artificial Sequence
  chemically synthesized
agagccattgaatgttttactg

SEQ ID NO: 1394185 - DNA, 22 bp, Artificial Sequence
  chemically synthesized
taagagccattgaatgttttac

SEQ ID NO: 1394186 - DNA, 22 bp, Artificial Sequence
  chemically synthesized
gacagatgttctaagagccatt

SEQ ID NO: 1394187 - DNA, 22 bp, Artificial Sequence
  chemically synthesized
ggacagatgttctaagagccat

SEQ ID NO: 1394188 - DNA, 22 bp, Artificial Sequence
  chemically synthesized
tggacagatgttctaagagcca

SEQ ID NO: 1394189 - DNA, 22 bp, Artificial Sequence
  chemically synthesized
ttggacagatgttctaagagcc

SEQ ID NO: 1394190 - DNA, 22 bp, Artificial Sequence
  chemically synthesized
tgtcacttttggacagatgttc

SEQ ID NO: 1394191 - DNA, 22 bp, Artificial Sequence
  chemically synthesized
aatggctcttagaacatctgtc

SEQ ID NO: 1394192 - DNA, 22 bp, Artificial Sequence
  chemically synthesized
ttagaacatctgtccaaaagtg

SEQ ID NO: 1394193 - DNA, 22 bp, Artificial Sequence
  chemically synthesized
agaacatctgtccaaaagtgac

SEQ ID NO: 1394194 - DNA, 22 bp, Artificial Sequence
  chemically synthesized
gaacatctgtccaaaagtgaca

SEQ ID NO: 1394195 - DNA, 22 bp, Artificial Sequence
  chemically synthesized
tccaaaagtgacacagttcact

SEQ ID NO: 1394196 - DNA, 22 bp, Artificial Sequence
  chemically synthesized
acttcttcgcacatttcattga

SEQ ID NO: 1394197 - DNA, 22 bp, Artificial Sequence
  chemically synthesized
tgtgacatgccggatcaatgaa

SEQ ID NO: 1394198 - DNA, 22 bp, Artificial Sequence
  chemically synthesized
cttcgcacatttcattgatccg

SEQ ID NO: 1394199 - DNA, 22 bp, Artificial Sequence
  chemically synthesized
ttcgcacatttcattgatccgg

SEQ ID NO: 1394200 - DNA, 22 bp, Artificial Sequence
  chemically synthesized
gctgtgtgacatgccggatcaa

SEQ ID NO: 1394201 - DNA, 22 bp, Artificial Sequence
  chemically synthesized
cgcacatttcattgatccggca

SEQ ID NO: 1394202 - DNA, 22 bp, Artificial Sequence
  chemically synthesized
gcacatttcattgatccggcat

SEQ ID NO: 1394203 - DNA, 22 bp, Artificial Sequence
  chemically synthesized
agtctggctgtgtgacatgccg

SEQ ID NO: 1394204 - DNA, 22 bp, Artificial Sequence
  chemically synthesized
cattgatccggcatgtcacaca

SEQ ID NO: 1394205 - DNA, 22 bp, Artificial Sequence
  chemically synthesized
attgatccggcatgtcacacag

SEQ ID NO: 1394206 - DNA, 22 bp, Artificial Sequence
  chemically synthesized
aagttgagtctggctgtgtgac

SEQ ID NO: 1394207 - DNA, 22 bp, Artificial Sequence
  chemically synthesized
gaagttgagtctggctgtgtga

SEQ ID NO: 1394208 - DNA, 22 bp, Artificial Sequence
  chemically synthesized
atccggcatgtcacacagccag

SEQ ID NO: 1394209 - DNA, 22 bp, Artificial Sequence
  chemically synthesized
acttgaagttgagtctggctgt

SEQ ID NO: 1394210 - DNA, 22 bp, Artificial Sequence
  chemically synthesized
cgcactcacttgaagttgagtc

SEQ ID NO: 1394211 - DNA, 22 bp, Artificial Sequence
  chemically synthesized
ccgcactcacttgaagttgagt

SEQ ID NO: 1394212 - DNA, 22 bp, Artificial Sequence
  chemically synthesized
aacttcaagtgagtgcggaagt

SEQ ID NO: 1394213 - DNA, 22 bp, Artificial Sequence
  chemically synthesized
gtacgtggaatcacttccgcac

SEQ ID NO: 1394214 - DNA, 22 bp, Artificial Sequence
  chemically synthesized
tggtacgtggaatcacttccgc

SEQ ID NO: 1394215 - DNA, 22 bp, Artificial Sequence
  chemically synthesized
ctggtacgtggaatcacttccg

SEQ ID NO: 1394216 - DNA, 22 bp, Artificial Sequence
  chemically synthesized
tctggtacgtggaatcacttcc

SEQ ID NO: 1394217 - DNA, 22 bp, Artificial Sequence
  chemically synthesized
caagtgagtgcggaagtgattc

SEQ ID NO: 1394218 - DNA, 22 bp, Artificial Sequence
  chemically synthesized
aagtgagtgcggaagtgattcc

SEQ ID NO: 1394219 - DNA, 22 bp, Artificial Sequence
  chemically synthesized
tcccctttctggtacgtggaat

SEQ ID NO: 1394220 - DNA, 22 bp, Artificial Sequence
  chemically synthesized
tgtcccctttctggtacgtgga

SEQ ID NO: 1394221 - DNA, 22 bp, Artificial Sequence
  chemically synthesized
ctgtcccctttctggtacgtgg

SEQ ID NO: 1394222 - DNA, 22 bp, Artificial Sequence
  chemically synthesized
cgcttctgtcccctttctggta

SEQ ID NO: 1394223 - DNA, 22 bp, Artificial Sequence
  chemically synthesized
ttccgcttctgtcccctttctg

SEQ ID NO: 1394224 - DNA, 22 bp, Artificial Sequence
  chemically synthesized
cacgtaccagaaaggggacaga

SEQ ID NO: 1394225 - DNA, 22 bp, Artificial Sequence
  chemically synthesized
atagctgttccgcttctgtccc

SEQ ID NO: 1394226 - DNA, 22 bp, Artificial Sequence
  chemically synthesized
gatagctgttccgcttctgtcc

SEQ ID NO: 1394227 - DNA, 22 bp, Artificial Sequence
  chemically synthesized
ttgatagctgttccgcttctgt

SEQ ID NO: 1394228 - DNA, 22 bp, Artificial Sequence
  chemically synthesized
agactcttgatagctgttccgc

SEQ ID NO: 1394229 - DNA, 22 bp, Artificial Sequence
  chemically synthesized
tcaagagtcttaatgtctacca

SEQ ID NO: 1394230 - DNA, 22 bp, Artificial Sequence
  chemically synthesized
atacaggtggaggtggtagaca

SEQ ID NO: 1394231 - DNA, 22 bp, Artificial Sequence
  chemically synthesized
tctgatacaggtggaggtggta

SEQ ID NO: 1394232 - DNA, 22 bp, Artificial Sequence
  chemically synthesized
aatgtctaccacctccacctgt

SEQ ID NO: 1394233 - DNA, 22 bp, Artificial Sequence
  chemically synthesized
tggttatctgatacaggtggag

SEQ ID NO: 1394234 - DNA, 22 bp, Artificial Sequence
  chemically synthesized
atgtctaccacctccacctgta

SEQ ID NO: 1394235 - DNA, 22 bp, Artificial Sequence
  chemically synthesized
ccacctccacctgtatcagata

SEQ ID NO: 1394236 - DNA, 22 bp, Artificial Sequence
  chemically synthesized
tgaagttgtggttatctgatac

SEQ ID NO: 1394237 - DNA, 22 bp, Artificial Sequence
  chemically synthesized
tgtgaagttgtggttatctgat

SEQ ID NO: 1394238 - DNA, 22 bp, Artificial Sequence
  chemically synthesized
cacctgtatcagataaccacaa

SEQ ID NO: 1394239 - DNA, 22 bp, Artificial Sequence
  chemically synthesized
tatcagataaccacaacttcac

SEQ ID NO: 1394240 - DNA, 22 bp, Artificial Sequence
  chemically synthesized
tgaaatatattctgtgaagttg

SEQ ID NO: 1394241 - DNA, 22 bp, Artificial Sequence
  chemically synthesized
ttatgaaatatattctgtgaag

SEQ ID NO: 1394242 - DNA, 22 bp, Artificial Sequence
  chemically synthesized
tacctattatgaaatatattct

SEQ ID NO: 1394243 - DNA, 22 bp, Artificial Sequence
  chemically synthesized
tgtacctattatgaaatatatt

SEQ ID NO: 1394244 - DNA, 22 bp, Artificial Sequence
  chemically synthesized
tctgtacctattatgaaatata

SEQ ID NO: 1394245 - DNA, 22 bp, Artificial Sequence
  chemically synthesized
cacagaatatatttcataatag

SEQ ID NO: 1394246 - DNA, 22 bp, Artificial Sequence
  chemically synthesized
acagaatatatttcataatagg

SEQ ID NO: 1394247 - DNA, 22 bp, Artificial Sequence
  chemically synthesized
tgtattctctgtacctattatg

SEQ ID NO: 1394248 - DNA, 22 bp, Artificial Sequence
  chemically synthesized
agttatgtattctctgtaccta

SEQ ID NO: 1394249 - DNA, 22 bp, Artificial Sequence
  chemically synthesized
aagttatgtattctctgtacct

SEQ ID NO: 1394250 - DNA, 22 bp, Artificial Sequence
  chemically synthesized
atttaagttatgtattctctgt

SEQ ID NO: 1394251 - DNA, 22 bp, Artificial Sequence
  chemically synthesized
catttaagttatgtattctctg

SEQ ID NO: 1394252 - DNA, 22 bp, Artificial Sequence
  chemically synthesized
cataataggtacagagaataca

SEQ ID NO: 1394253 - DNA, 22 bp, Artificial Sequence
  chemically synthesized
ataataggtacagagaatacat

SEQ ID NO: 1394254 - DNA, 22 bp, Artificial Sequence
  chemically synthesized
ataatgatgagtttcatttaag

SEQ ID NO: 1394255 - DNA, 22 bp, Artificial Sequence
  chemically synthesized
aataatgatgagtttcatttaa

SEQ ID NO: 1394256 - DNA, 22 bp, Artificial Sequence
  chemically synthesized
taataatgatgagtttcattta

SEQ ID NO: 1394257 - DNA, 22 bp, Artificial Sequence
  chemically synthesized
ttaataatgatgagtttcattt

SEQ ID NO: 1394258 - DNA, 22 bp, Artificial Sequence
  chemically synthesized
tttttaataatgatgagtttca

SEQ ID NO: 1394259 - DNA, 22 bp, Artificial Sequence
  chemically synthesized
atttttaataatgatgagtttc

SEQ ID NO: 1394260 - DNA, 22 bp, Artificial Sequence
  chemically synthesized
aaatgaaactcatcattattaa

SEQ ID NO: 1394261 - DNA, 22 bp, Artificial Sequence
  chemically synthesized
gaaagtttatttttaataatga

SEQ ID NO: 1394262 - DNA, 22 bp, Artificial Sequence
  chemically synthesized
aatgaaactcatcattattaaa

SEQ ID NO: 1394263 - DNA, 22 bp, Artificial Sequence
  chemically synthesized
ggaaagtttatttttaataatg

SEQ ID NO: 1394264 - DNA, 22 bp, Artificial Sequence
  chemically synthesized
atcattattaaaaataaacttt

SEQ ID NO: 1394265 - DNA, 22 bp, Artificial Sequence
  chemically synthesized
ttaaaaataaactttccaaata

SEQ ID NO: 1394266 - DNA, 22 bp, Artificial Sequence
  chemically synthesized
aaaataaactttccaaatattt

SEQ ID NO: 1394267 - DNA, 22 bp, Artificial Sequence
  chemically synthesized
aaataaatagagaaaatatttg

SEQ ID NO: 1394268 - DNA, 22 bp, Artificial Sequence
  chemically synthesized
aaaataaatagagaaaatattt

SEQ ID NO: 1394269 - DNA, 22 bp, Artificial Sequence
  chemically synthesized
catttaaaataaatagagaaaa

SEQ ID NO: 1394270 - DNA, 22 bp, Artificial Sequence
  chemically synthesized
tccaaatattttctctatttat

SEQ ID NO: 1394271 - DNA, 22 bp, Artificial Sequence
  chemically synthesized
attacatttaaaataaatagag

SEQ ID NO: 1394272 - DNA, 22 bp, Artificial Sequence
  chemically synthesized
ccaaatattttctctatttatt

SEQ ID NO: 1394273 - DNA, 22 bp, Artificial Sequence
  chemically synthesized
aattacatttaaaataaataga

SEQ ID NO: 1394274 - DNA, 22 bp, Artificial Sequence
  chemically synthesized
caaatattttctctatttattt

SEQ ID NO: 1394275 - DNA, 22 bp, Artificial Sequence
  chemically synthesized
taaagatttaattacatttaaa

SEQ ID NO: 1394276 - DNA, 22 bp, Artificial Sequence
  chemically synthesized
tctctatttattttaaatgtaa

SEQ ID NO: 1394277 - DNA, 22 bp, Artificial Sequence
  chemically synthesized
ataaagatttaattacatttaa

SEQ ID NO: 1394278 - DNA, 22 bp, Artificial Sequence
  chemically synthesized
ctctatttattttaaatgtaat

SEQ ID NO: 1394279 - DNA, 22 bp, Artificial Sequence
  chemically synthesized
tctatttattttaaatgtaatt

SEQ ID NO: 1394280 - DNA, 22 bp, Artificial Sequence
  chemically synthesized
cttataaagatttaattacatt

SEQ ID NO: 1394281 - DNA, 22 bp, Artificial Sequence
  chemically synthesized
tatttattttaaatgtaattaa

SEQ ID NO: 1394282 - DNA, 22 bp, Artificial Sequence
  chemically synthesized
gcttataaagatttaattacat

SEQ ID NO: 1394283 - DNA, 22 bp, Artificial Sequence
  chemically synthesized
tttattttaaatgtaattaaat

SEQ ID NO: 1394284 - DNA, 22 bp, Artificial Sequence
  chemically synthesized
attttaaatgtaattaaatctt

SEQ ID NO: 1394285 - DNA, 22 bp, Artificial Sequence
  chemically synthesized
ttttaaatgtaattaaatcttt

SEQ ID NO: 1394286 - DNA, 22 bp, Artificial Sequence
  chemically synthesized
cagaccttgcttataaagattt

SEQ ID NO: 1394287 - DNA, 22 bp, Artificial Sequence
  chemically synthesized
taaatgtaattaaatctttata

SEQ ID NO: 1394288 - DNA, 22 bp, Artificial Sequence
  chemically synthesized
gcagaccttgcttataaagatt

SEQ ID NO: 1394289 - DNA, 22 bp, Artificial Sequence
  chemically synthesized
aaatgtaattaaatctttataa

SEQ ID NO: 1394290 - DNA, 22 bp, Artificial Sequence
  chemically synthesized
aatgtaattaaatctttataag

SEQ ID NO: 1394291 - DNA, 22 bp, Artificial Sequence
  chemically synthesized
aatctttataagcaaggtctgc

SEQ ID NO: 1394292 - DNA, 22 bp, Artificial Sequence
  chemically synthesized
gaataaaaatttgcagaccttg

SEQ ID NO: 1394293 - DNA, 22 bp, Artificial Sequence
  chemically synthesized
tataagcaaggtctgcaaattt

SEQ ID NO: 1394294 - DNA, 22 bp, Artificial Sequence
  chemically synthesized
ataagcaaggtctgcaaatttt

SEQ ID NO: 1394295 - DNA, 22 bp, Artificial Sequence
  chemically synthesized
taagcaaggtctgcaaattttt

SEQ ID NO: 1394296 - DNA, 22 bp, Artificial Sequence
  chemically synthesized
aggaaaaaaaaattagaataaa

SEQ ID NO: 1394297 - DNA, 22 bp, Artificial Sequence
  chemically synthesized
tcaggaaaaaaaaattagaata

SEQ ID NO: 1394298 - DNA, 22 bp, Artificial Sequence
  chemically synthesized
ctctcaggaaaaaaaaattaga

SEQ ID NO: 1394299 - DNA, 22 bp, Artificial Sequence
  chemically synthesized
caaatttttattctaatttttt

SEQ ID NO: 1394300 - DNA, 22 bp, Artificial Sequence
  chemically synthesized
actctcaggaaaaaaaaattag

SEQ ID NO: 1394301 - DNA, 22 bp, Artificial Sequence
  chemically synthesized
ttattctaatttttttttcctg

SEQ ID NO: 1394302 - DNA, 22 bp, Artificial Sequence
  chemically synthesized
tattctaatttttttttcctga

SEQ ID NO: 1394303 - DNA, 22 bp, Artificial Sequence
  chemically synthesized
attctaatttttttttcctgag

SEQ ID NO: 1394304 - DNA, 22 bp, Artificial Sequence
  chemically synthesized
ttctaatttttttttcctgaga

SEQ ID NO: 1394305 - DNA, 22 bp, Artificial Sequence
  chemically synthesized
taatttttttttcctgagagta

SEQ ID NO: 1394306 - DNA, 22 bp, Artificial Sequence
  chemically synthesized
atttttttttcctgagagtaag

SEQ ID NO: 1394307 - DNA, 22 bp, Artificial Sequence
  chemically synthesized
ttttttcctgagagtaagtggt

SEQ ID NO: 1394308 - DNA, 22 bp, Artificial Sequence
  chemically synthesized
tttttcctgagagtaagtggtt

SEQ ID NO: 1394309 - DNA, 22 bp, Artificial Sequence
  chemically synthesized
ttttcctgagagtaagtggtta

SEQ ID NO: 1394310 - DNA, 22 bp, Artificial Sequence
  chemically synthesized
tttcctgagagtaagtggttat

SEQ ID NO: 1394311 - DNA, 22 bp, Artificial Sequence
  chemically synthesized
tagagtaacataataaccactt

SEQ ID NO: 1394312 - DNA, 22 bp, Artificial Sequence
  chemically synthesized
ttcctgagagtaagtggttatt

SEQ ID NO: 1394313 - DNA, 22 bp, Artificial Sequence
  chemically synthesized
tcctgagagtaagtggttatta

SEQ ID NO: 1394314 - DNA, 22 bp, Artificial Sequence
  chemically synthesized
cctgagagtaagtggttattat

SEQ ID NO: 1394315 - DNA, 22 bp, Artificial Sequence
  chemically synthesized
ctgagagtaagtggttattatg

SEQ ID NO: 1394316 - DNA, 22 bp, Artificial Sequence
  chemically synthesized
aactatagagtaacataataac

SEQ ID NO: 1394317 - DNA, 22 bp, Artificial Sequence
  chemically synthesized
caactatagagtaacataataa

SEQ ID NO: 1394318 - DNA, 22 bp, Artificial Sequence
  chemically synthesized
agagtaagtggttattatgtta

SEQ ID NO: 1394319 - DNA, 22 bp, Artificial Sequence
  chemically synthesized
tcaactatagagtaacataata

SEQ ID NO: 1394320 - DNA, 22 bp, Artificial Sequence
  chemically synthesized
gttttcaactatagagtaacat

SEQ ID NO: 1394321 - DNA, 22 bp, Artificial Sequence
  chemically synthesized
ggttttcaactatagagtaaca

SEQ ID NO: 1394322 - DNA, 22 bp, Artificial Sequence
  chemically synthesized
tggttttcaactatagagtaac

SEQ ID NO: 1394323 - DNA, 22 bp, Artificial Sequence
  chemically synthesized
attttggttttcaactatagag

SEQ ID NO: 1394324 - DNA, 22 bp, Artificial Sequence
  chemically synthesized
tcattttggttttcaactatag

SEQ ID NO: 1394325 - DNA, 22 bp, Artificial Sequence
  chemically synthesized
ttatgttactctatagttgaaa

SEQ ID NO: 1394326 - DNA, 22 bp, Artificial Sequence
  chemically synthesized
tctcattttggttttcaactat

SEQ ID NO: 1394327 - DNA, 22 bp, Artificial Sequence
  chemically synthesized
ctctcattttggttttcaacta

SEQ ID NO: 1394328 - DNA, 22 bp, Artificial Sequence
  chemically synthesized
tctctcattttggttttcaact

SEQ ID NO: 1394329 - DNA, 22 bp, Artificial Sequence
  chemically synthesized
tgttactctatagttgaaaacc

SEQ ID NO: 1394330 - DNA, 22 bp, Artificial Sequence
  chemically synthesized
ttctctcattttggttttcaac

SEQ ID NO: 1394331 - DNA, 22 bp, Artificial Sequence
  chemically synthesized
ttttctctcattttggttttca

SEQ ID NO: 1394332 - DNA, 22 bp, Artificial Sequence
  chemically synthesized
cttttctctcattttggttttc

SEQ ID NO: 1394333 - DNA, 22 bp, Artificial Sequence
  chemically synthesized
tcttttctctcattttggtttt

SEQ ID NO: 1394334 - DNA, 22 bp, Artificial Sequence
  chemically synthesized
ctctatagttgaaaaccaaaat

SEQ ID NO: 1394335 - DNA, 22 bp, Artificial Sequence
  chemically synthesized
ttcttttctctcattttggttt

SEQ ID NO: 1394336 - DNA, 22 bp, Artificial Sequence
  chemically synthesized
tatagttgaaaaccaaaatgag

SEQ ID NO: 1394337 - DNA, 22 bp, Artificial Sequence
  chemically synthesized
tagttgaaaaccaaaatgagag

SEQ ID NO: 1394338 - DNA, 22 bp, Artificial Sequence
  chemically synthesized
tgtcatttttcttttctctcat

SEQ ID NO: 1394339 - DNA, 22 bp, Artificial Sequence
  chemically synthesized
aaaaccaaaatgagagaaaaga

SEQ ID NO: 1394340 - DNA, 22 bp, Artificial Sequence
  chemically synthesized
attatgtcatttttcttttctc

SEQ ID NO: 1394341 - DNA, 22 bp, Artificial Sequence
  chemically synthesized
tgattatgtcatttttcttttc

SEQ ID NO: 1394342 - DNA, 22 bp, Artificial Sequence
  chemically synthesized
actctgattatgtcatttttct

SEQ ID NO: 1394343 - DNA, 22 bp, Artificial Sequence
  chemically synthesized
taactctgattatgtcattttt

SEQ ID NO: 1394344 - DNA, 22 bp, Artificial Sequence
  chemically synthesized
tctaactctgattatgtcattt

SEQ ID NO: 1394345 - DNA, 22 bp, Artificial Sequence
  chemically synthesized
tatctctctaactctgattatg

SEQ ID NO: 1394346 - DNA, 22 bp, Artificial Sequence
  chemically synthesized
cctatatctctctaactctgat

SEQ ID NO: 1394347 - DNA, 22 bp, Artificial Sequence
  chemically synthesized
acctatatctctctaactctga

SEQ ID NO: 1394348 - DNA, 22 bp, Artificial Sequence
  chemically synthesized
tacctatatctctctaactctg

SEQ ID NO: 1394349 - DNA, 22 bp, Artificial Sequence
  chemically synthesized
ttacctatatctctctaactct

SEQ ID NO: 1394350 - DNA, 22 bp, Artificial Sequence
  chemically synthesized
gagagatataggtaaaaaccct

SEQ ID NO: 1394351 - DNA, 22 bp, Artificial Sequence
  chemically synthesized
caagtaccaaaagaaaaagtca

SEQ ID NO: 1394352 - DNA, 22 bp, Artificial Sequence
  chemically synthesized
caaagtcctacaagtaccaaaa

SEQ ID NO: 1394353 - DNA, 22 bp, Artificial Sequence
  chemically synthesized
tgcaaagtcctacaagtaccaa

SEQ ID NO: 1394354 - DNA, 22 bp, Artificial Sequence
  chemically synthesized
ctgcaaagtcctacaagtacca

SEQ ID NO: 1394355 - DNA, 22 bp, Artificial Sequence
  chemically synthesized
actttttcttttggtacttgta

SEQ ID NO: 1394356 - DNA, 22 bp, Artificial Sequence
  chemically synthesized
tttcttttggtacttgtaggac

SEQ ID NO: 1394357 - DNA, 22 bp, Artificial Sequence
  chemically synthesized
ttcttttggtacttgtaggact

SEQ ID NO: 1394358 - DNA, 22 bp, Artificial Sequence
  chemically synthesized
tcttttggtacttgtaggactt

SEQ ID NO: 1394359 - DNA, 22 bp, Artificial Sequence
  chemically synthesized
cttttggtacttgtaggacttt

SEQ ID NO: 1394360 - DNA, 22 bp, Artificial Sequence
  chemically synthesized
ttttggtacttgtaggactttg

SEQ ID NO: 1394361 - DNA, 22 bp, Artificial Sequence
  chemically synthesized
ttggtacttgtaggactttgca

SEQ ID NO: 1394362 - DNA, 22 bp, Artificial Sequence
  chemically synthesized
tggtacttgtaggactttgcag

SEQ ID NO: 1394363 - DNA, 22 bp, Artificial Sequence
  chemically synthesized
ggtacttgtaggactttgcaga

SEQ ID NO: 1394364 - DNA, 22 bp, Artificial Sequence
  chemically synthesized
gtacttgtaggactttgcagaa

SEQ ID NO: 1394365 - DNA, 22 bp, Artificial Sequence
  chemically synthesized
agatcaaaagtcttctgcaaag

SEQ ID NO: 1394366 - DNA, 22 bp, Artificial Sequence
  chemically synthesized
gtaggactttgcagaagacttt

SEQ ID NO: 1394367 - DNA, 22 bp, Artificial Sequence
  chemically synthesized
ccattcagatcaaaagtcttct

SEQ ID NO: 1394368 - DNA, 22 bp, Artificial Sequence
  chemically synthesized
taggactttgcagaagactttt

SEQ ID NO: 1394369 - DNA, 22 bp, Artificial Sequence
  chemically synthesized
ctgccattcagatcaaaagtct

SEQ ID NO: 1394370 - DNA, 22 bp, Artificial Sequence
  chemically synthesized
actgccattcagatcaaaagtc

SEQ ID NO: 1394371 - DNA, 22 bp, Artificial Sequence
  chemically synthesized
tgcagaagacttttgatctgaa

SEQ ID NO: 1394372 - DNA, 22 bp, Artificial Sequence
  chemically synthesized
gcagaagacttttgatctgaat

SEQ ID NO: 1394373 - DNA, 22 bp, Artificial Sequence
  chemically synthesized
cagaagacttttgatctgaatg

SEQ ID NO: 1394374 - DNA, 22 bp, Artificial Sequence
  chemically synthesized
aggaaacttactgccattcaga

SEQ ID NO: 1394375 - DNA, 22 bp, Artificial Sequence
  chemically synthesized
ctgaggaaacttactgccattc

SEQ ID NO: 1394376 - DNA, 22 bp, Artificial Sequence
  chemically synthesized
cctgaggaaacttactgccatt

SEQ ID NO: 1394377 - DNA, 22 bp, Artificial Sequence
  chemically synthesized
tcctgaggaaacttactgccat

SEQ ID NO: 1394378 - DNA, 22 bp, Artificial Sequence
  chemically synthesized
ttgatctgaatggcagtaagtt

SEQ ID NO: 1394379 - DNA, 22 bp, Artificial Sequence
  chemically synthesized
tgatctgaatggcagtaagttt

SEQ ID NO: 1394380 - DNA, 22 bp, Artificial Sequence
  chemically synthesized
attttcctgaggaaacttactg

SEQ ID NO: 1394381 - DNA, 22 bp, Artificial Sequence
  chemically synthesized
gatctgaatggcagtaagtttc

SEQ ID NO: 1394382 - DNA, 22 bp, Artificial Sequence
  chemically synthesized
cattttcctgaggaaacttact

SEQ ID NO: 1394383 - DNA, 22 bp, Artificial Sequence
  chemically synthesized
atctgaatggcagtaagtttcc

SEQ ID NO: 1394384 - DNA, 22 bp, Artificial Sequence
  chemically synthesized
atttcattttcctgaggaaact

SEQ ID NO: 1394385 - DNA, 22 bp, Artificial Sequence
  chemically synthesized
aatggcagtaagtttcctcagg

SEQ ID NO: 1394386 - DNA, 22 bp, Artificial Sequence
  chemically synthesized
aggtagatgatattaatttcat

SEQ ID NO: 1394387 - DNA, 22 bp, Artificial Sequence
  chemically synthesized
aaggtagatgatattaatttca

SEQ ID NO: 1394388 - DNA, 22 bp, Artificial Sequence
  chemically synthesized
cctcaggaaaatgaaattaata

SEQ ID NO: 1394389 - DNA, 22 bp, Artificial Sequence
  chemically synthesized
ctcaggaaaatgaaattaatat

SEQ ID NO: 1394390 - DNA, 22 bp, Artificial Sequence
  chemically synthesized
tttaaggtagatgatattaatt

SEQ ID NO: 1394391 - DNA, 22 bp, Artificial Sequence
  chemically synthesized
aggaaaatgaaattaatatcat

SEQ ID NO: 1394392 - DNA, 22 bp, Artificial Sequence
  chemically synthesized
taaccacctatttaaggtagat

SEQ ID NO: 1394393 - DNA, 22 bp, Artificial Sequence
  chemically synthesized
atatcatctaccttaaataggt

SEQ ID NO: 1394394 - DNA, 22 bp, Artificial Sequence
  chemically synthesized
atgtaatcactataaccaccta

SEQ ID NO: 1394395 - DNA, 22 bp, Artificial Sequence
  chemically synthesized
gctcatgtaatcactataacca

SEQ ID NO: 1394396 - DNA, 22 bp, Artificial Sequence
  chemically synthesized
ccttaaataggtggttatagtg

SEQ ID NO: 1394397 - DNA, 22 bp, Artificial Sequence
  chemically synthesized
aaataggtggttatagtgatta

SEQ ID NO: 1394398 - DNA, 22 bp, Artificial Sequence
  chemically synthesized
aataggtggttatagtgattac

SEQ ID NO: 1394399 - DNA, 22 bp, Artificial Sequence
  chemically synthesized
tataaacattagctcatgtaat

SEQ ID NO: 1394400 - DNA, 22 bp, Artificial Sequence
  chemically synthesized
gtataaacattagctcatgtaa

SEQ ID NO: 1394401 - DNA, 22 bp, Artificial Sequence
  chemically synthesized
tagtgattacatgagctaatgt

SEQ ID NO: 1394402 - DNA, 22 bp, Artificial Sequence
  chemically synthesized
catgagctaatgtttatacaaa

SEQ ID NO: 1394403 - DNA, 22 bp, Artificial Sequence
  chemically synthesized
atgtttatacaaatgctgtctt

SEQ ID NO: 1394404 - DNA, 22 bp, Artificial Sequence
  chemically synthesized
agaagggaaggagtaaaagaca

SEQ ID NO: 1394405 - DNA, 22 bp, Artificial Sequence
  chemically synthesized
atacaaatgctgtcttttactc

SEQ ID NO: 1394406 - DNA, 22 bp, Artificial Sequence
  chemically synthesized
tacaaatgctgtcttttactcc

SEQ ID NO: 1394407 - DNA, 22 bp, Artificial Sequence
  chemically synthesized
aaatagaagctaagaagggaag

SEQ ID NO: 1394408 - DNA, 22 bp, Artificial Sequence
  chemically synthesized
caaatagaagctaagaagggaa

SEQ ID NO: 1394409 - DNA, 22 bp, Artificial Sequence
  chemically synthesized
tcttttactccttcccttctta

SEQ ID NO: 1394410 - DNA, 22 bp, Artificial Sequence
  chemically synthesized
tcaaatagaagctaagaaggga

SEQ ID NO: 1394411 - DNA, 22 bp, Artificial Sequence
  chemically synthesized
ttcaaatagaagctaagaaggg

SEQ ID NO: 1394412 - DNA, 22 bp, Artificial Sequence
  chemically synthesized
tttcaaatagaagctaagaagg

SEQ ID NO: 1394413 - DNA, 22 bp, Artificial Sequence
  chemically synthesized
ttactccttcccttcttagctt

SEQ ID NO: 1394414 - DNA, 22 bp, Artificial Sequence
  chemically synthesized
tactccttcccttcttagcttc

SEQ ID NO: 1394415 - DNA, 22 bp, Artificial Sequence
  chemically synthesized
actccttcccttcttagcttct

SEQ ID NO: 1394416 - DNA, 22 bp, Artificial Sequence
  chemically synthesized
ctccttcccttcttagcttcta

SEQ ID NO: 1394417 - DNA, 22 bp, Artificial Sequence
  chemically synthesized
cttcccttcttagcttctattt

SEQ ID NO: 1394418 - DNA, 22 bp, Artificial Sequence
  chemically synthesized
ccaaagttttttcaaatagaag

SEQ ID NO: 1394419 - DNA, 22 bp, Artificial Sequence
  chemically synthesized
accaaagttttttcaaatagaa

SEQ ID NO: 1394420 - DNA, 22 bp, Artificial Sequence
  chemically synthesized
cccttcttagcttctatttgaa

SEQ ID NO: 1394421 - DNA, 22 bp, Artificial Sequence
  chemically synthesized
ccttcttagcttctatttgaaa

SEQ ID NO: 1394422 - DNA, 22 bp, Artificial Sequence
  chemically synthesized
cttaccaaagttttttcaaata

SEQ ID NO: 1394423 - DNA, 22 bp, Artificial Sequence
  chemically synthesized
cttagcttctatttgaaaaaac

SEQ ID NO: 1394424 - DNA, 22 bp, Artificial Sequence
  chemically synthesized
ttagcttctatttgaaaaaact

SEQ ID NO: 1394425 - DNA, 22 bp, Artificial Sequence
  chemically synthesized
agcttctatttgaaaaaacttt

SEQ ID NO: 1394426 - DNA, 22 bp, Artificial Sequence
  chemically synthesized
cagctccttaccaaagtttttt

SEQ ID NO: 1394427 - DNA, 22 bp, Artificial Sequence
  chemically synthesized
gcttctatttgaaaaaactttg

SEQ ID NO: 1394428 - DNA, 22 bp, Artificial Sequence
  chemically synthesized
ctatttgaaaaaactttggtaa

SEQ ID NO: 1394429 - DNA, 22 bp, Artificial Sequence
  chemically synthesized
tatttgaaaaaactttggtaag

SEQ ID NO: 1394430 - DNA, 22 bp, Artificial Sequence
  chemically synthesized
tttgaaaaaactttggtaagga

SEQ ID NO: 1394431 - DNA, 22 bp, Artificial Sequence
  chemically synthesized
aaaagctgcagctccttaccaa

SEQ ID NO: 1394432 - DNA, 22 bp, Artificial Sequence
  chemically synthesized
gaaaagctgcagctccttacca

SEQ ID NO: 1394433 - DNA, 22 bp, Artificial Sequence
  chemically synthesized
tgaaaagctgcagctccttacc

SEQ ID NO: 1394434 - DNA, 22 bp, Artificial Sequence
  chemically synthesized
gaaaaaactttggtaaggagct

SEQ ID NO: 1394435 - DNA, 22 bp, Artificial Sequence
  chemically synthesized
aaaaaactttggtaaggagctg

SEQ ID NO: 1394436 - DNA, 22 bp, Artificial Sequence
  chemically synthesized
tggcccctttgaaaagctgcag

SEQ ID NO: 1394437 - DNA, 22 bp, Artificial Sequence
  chemically synthesized
atggcccctttgaaaagctgca

SEQ ID NO: 1394438 - DNA, 22 bp, Artificial Sequence
  chemically synthesized
tggtaaggagctgcagcttttc

SEQ ID NO: 1394439 - DNA, 22 bp, Artificial Sequence
  chemically synthesized
ggtaaggagctgcagcttttca

SEQ ID NO: 1394440 - DNA, 22 bp, Artificial Sequence
  chemically synthesized
gtaaggagctgcagcttttcaa

SEQ ID NO: 1394441 - DNA, 22 bp, Artificial Sequence
  chemically synthesized
cagcttttcaaaggggccataa

SEQ ID NO: 1394442 - DNA, 22 bp, Artificial Sequence
  chemically synthesized
cacggagtcaagtttatggccc

SEQ ID NO: 1394443 - DNA, 22 bp, Artificial Sequence
  chemically synthesized
ttcaaaggggccataaacttga

SEQ ID NO: 1394444 - DNA, 22 bp, Artificial Sequence
  chemically synthesized
tcaaaggggccataaacttgac

SEQ ID NO: 1394445 - DNA, 22 bp, Artificial Sequence
  chemically synthesized
caaaggggccataaacttgact

SEQ ID NO: 1394446 - DNA, 22 bp, Artificial Sequence
  chemically synthesized
gaatctgcacggagtcaagttt

SEQ ID NO: 1394447 - DNA, 22 bp, Artificial Sequence
  chemically synthesized
aaaggggccataaacttgactc

SEQ ID NO: 1394448 - DNA, 22 bp, Artificial Sequence
  chemically synthesized
agaatctgcacggagtcaagtt

SEQ ID NO: 1394449 - DNA, 22 bp, Artificial Sequence
  chemically synthesized
cttagaatctgcacggagtcaa

SEQ ID NO: 1394450 - DNA, 22 bp, Artificial Sequence
  chemically synthesized
ccttagaatctgcacggagtca

SEQ ID NO: 1394451 - DNA, 22 bp, Artificial Sequence
  chemically synthesized
ggccttccttagaatctgcacg

SEQ ID NO: 1394452 - DNA, 22 bp, Artificial Sequence
  chemically synthesized
actaggccttccttagaatctg

SEQ ID NO: 1394453 - DNA, 22 bp, Artificial Sequence
  chemically synthesized
gactccgtgcagattctaagga

SEQ ID NO: 1394454 - DNA, 22 bp, Artificial Sequence
  chemically synthesized
ctcactaggccttccttagaat

SEQ ID NO: 1394455 - DNA, 22 bp, Artificial Sequence
  chemically synthesized
actccgtgcagattctaaggaa

SEQ ID NO: 1394456 - DNA, 22 bp, Artificial Sequence
  chemically synthesized
cctcactaggccttccttagaa

SEQ ID NO: 1394457 - DNA, 22 bp, Artificial Sequence
  chemically synthesized
tcctcactaggccttccttaga

SEQ ID NO: 1394458 - DNA, 22 bp, Artificial Sequence
  chemically synthesized
cgtgcagattctaaggaaggcc

SEQ ID NO: 1394459 - DNA, 22 bp, Artificial Sequence
  chemically synthesized
gcccatctttcctcactaggcc

SEQ ID NO: 1394460 - DNA, 22 bp, Artificial Sequence
  chemically synthesized
cctagcccatctttcctcacta

SEQ ID NO: 1394461 - DNA, 22 bp, Artificial Sequence
  chemically synthesized
taaggaaggcctagtgaggaaa

SEQ ID NO: 1394462 - DNA, 22 bp, Artificial Sequence
  chemically synthesized
aggaaggcctagtgaggaaaga

SEQ ID NO: 1394463 - DNA, 22 bp, Artificial Sequence
  chemically synthesized
aagcaactacctagcccatctt

SEQ ID NO: 1394464 - DNA, 22 bp, Artificial Sequence
  chemically synthesized
gtgaggaaagatgggctaggta

SEQ ID NO: 1394465 - DNA, 22 bp, Artificial Sequence
  chemically synthesized
gagaactgaagcaactacctag

SEQ ID NO: 1394466 - DNA, 22 bp, Artificial Sequence
  chemically synthesized
agagaactgaagcaactaccta

SEQ ID NO: 1394467 - DNA, 22 bp, Artificial Sequence
  chemically synthesized
cacataatttagagaactgaag

SEQ ID NO: 1394468 - DNA, 22 bp, Artificial Sequence
  chemically synthesized
gcacataatttagagaactgaa

SEQ ID NO: 1394469 - DNA, 22 bp, Artificial Sequence
  chemically synthesized
ttgcacataatttagagaactg

SEQ ID NO: 1394470 - DNA, 22 bp, Artificial Sequence
  chemically synthesized
ggtagttgcttcagttctctaa

SEQ ID NO: 1394471 - DNA, 22 bp, Artificial Sequence
  chemically synthesized
agattcttgcacataatttaga

SEQ ID NO: 1394472 - DNA, 22 bp, Artificial Sequence
  chemically synthesized
aagattcttgcacataatttag

SEQ ID NO: 1394473 - DNA, 22 bp, Artificial Sequence
  chemically synthesized
taagattcttgcacataattta

SEQ ID NO: 1394474 - DNA, 22 bp, Artificial Sequence
  chemically synthesized
cttcagttctctaaattatgtg

SEQ ID NO: 1394475 - DNA, 22 bp, Artificial Sequence
  chemically synthesized
cagttctctaaattatgtgcaa

SEQ ID NO: 1394476 - DNA, 22 bp, Artificial Sequence
  chemically synthesized
attttaagattcttgcacataa

SEQ ID NO: 1394477 - DNA, 22 bp, Artificial Sequence
  chemically synthesized
agttctctaaattatgtgcaag

SEQ ID NO: 1394478 - DNA, 22 bp, Artificial Sequence
  chemically synthesized
cattttaagattcttgcacata

SEQ ID NO: 1394479 - DNA, 22 bp, Artificial Sequence
  chemically synthesized
tctaaattatgtgcaagaatct

SEQ ID NO: 1394480 - DNA, 22 bp, Artificial Sequence
  chemically synthesized
taaattatgtgcaagaatctta

SEQ ID NO: 1394481 - DNA, 22 bp, Artificial Sequence
  chemically synthesized
catatttcattttaagattctt

SEQ ID NO: 1394482 - DNA, 22 bp, Artificial Sequence
  chemically synthesized
gcatatttcattttaagattct

SEQ ID NO: 1394483 - DNA, 22 bp, Artificial Sequence
  chemically synthesized
aattatgtgcaagaatcttaaa

SEQ ID NO: 1394484 - DNA, 22 bp, Artificial Sequence
  chemically synthesized
ttgcatatttcattttaagatt

SEQ ID NO: 1394485 - DNA, 22 bp, Artificial Sequence
  chemically synthesized
cttgcatatttcattttaagat

SEQ ID NO: 1394486 - DNA, 22 bp, Artificial Sequence
  chemically synthesized
tcttgcatatttcattttaaga

SEQ ID NO: 1394487 - DNA, 22 bp, Artificial Sequence
  chemically synthesized
tgtgcaagaatcttaaaatgaa

SEQ ID NO: 1394488 - DNA, 22 bp, Artificial Sequence
  chemically synthesized
tatctttcttgcatatttcatt

SEQ ID NO: 1394489 - DNA, 22 bp, Artificial Sequence
  chemically synthesized
gactgtatctttcttgcatatt

SEQ ID NO: 1394490 - DNA, 22 bp, Artificial Sequence
  chemically synthesized
aaaatgaaatatgcaagaaaga

SEQ ID NO: 1394491 - DNA, 22 bp, Artificial Sequence
  chemically synthesized
aaatgaaatatgcaagaaagat

SEQ ID NO: 1394492 - DNA, 22 bp, Artificial Sequence
  chemically synthesized
tccacccctagactgtatcttt

SEQ ID NO: 1394493 - DNA, 22 bp, Artificial Sequence
  chemically synthesized
cctgtccacccctagactgtat

SEQ ID NO: 1394494 - DNA, 22 bp, Artificial Sequence
  chemically synthesized
acctgtccacccctagactgta

SEQ ID NO: 1394495 - DNA, 22 bp, Artificial Sequence
  chemically synthesized
tacctgtccacccctagactgt

SEQ ID NO: 1394496 - DNA, 22 bp, Artificial Sequence
  chemically synthesized
tttacctgtccacccctagact

SEQ ID NO: 1394497 - DNA, 22 bp, Artificial Sequence
  chemically synthesized
ttctttacctgtccacccctag

SEQ ID NO: 1394498 - DNA, 22 bp, Artificial Sequence
  chemically synthesized
cctgttctttacctgtccaccc

SEQ ID NO: 1394499 - DNA, 22 bp, Artificial Sequence
  chemically synthesized
tccctgttctttacctgtccac

SEQ ID NO: 1394500 - DNA, 22 bp, Artificial Sequence
  chemically synthesized
cctctccctgttctttacctgt

SEQ ID NO: 1394501 - DNA, 22 bp, Artificial Sequence
  chemically synthesized
acctctccctgttctttacctg

SEQ ID NO: 1394502 - DNA, 22 bp, Artificial Sequence
  chemically synthesized
tacctctccctgttctttacct

SEQ ID NO: 1394503 - DNA, 22 bp, Artificial Sequence
  chemically synthesized
ggggtggacaggtaaagaacag

SEQ ID NO: 1394504 - DNA, 22 bp, Artificial Sequence
  chemically synthesized
cctttacctctccctgttcttt

SEQ ID NO: 1394505 - DNA, 22 bp, Artificial Sequence
  chemically synthesized
gcctttacctctccctgttctt

SEQ ID NO: 1394506 - DNA, 22 bp, Artificial Sequence
  chemically synthesized
ttgcctttacctctccctgttc

SEQ ID NO: 1394507 - DNA, 22 bp, Artificial Sequence
  chemically synthesized
agccaaatattcttgcctttac

SEQ ID NO: 1394508 - DNA, 22 bp, Artificial Sequence
  chemically synthesized
ttcagccaaatattcttgcctt

SEQ ID NO: 1394509 - DNA, 22 bp, Artificial Sequence
  chemically synthesized
cattattcagccaaatattctt

SEQ ID NO: 1394510 - DNA, 22 bp, Artificial Sequence
  chemically synthesized
gaaaaacatattccattattca

SEQ ID NO: 1394511 - DNA, 22 bp, Artificial Sequence
  chemically synthesized
ggctgaataatggaatatgttt

SEQ ID NO: 1394512 - DNA, 22 bp, Artificial Sequence
  chemically synthesized
gctgaataatggaatatgtttt

SEQ ID NO: 1394513 - DNA, 22 bp, Artificial Sequence
  chemically synthesized
tcagaatggctagaaaaacata

SEQ ID NO: 1394514 - DNA, 22 bp, Artificial Sequence
  chemically synthesized
aataatggaatatgtttttcta

SEQ ID NO: 1394515 - DNA, 22 bp, Artificial Sequence
  chemically synthesized
ccaattgtcagaatggctagaa

SEQ ID NO: 1394516 - DNA, 22 bp, Artificial Sequence
  chemically synthesized
ttctagccattctgacaattgg

SEQ ID NO: 1394517 - DNA, 22 bp, Artificial Sequence
  chemically synthesized
tctagccattctgacaattggt

SEQ ID NO: 1394518 - DNA, 22 bp, Artificial Sequence
  chemically synthesized
ctagccattctgacaattggta

SEQ ID NO: 1394519 - DNA, 22 bp, Artificial Sequence
  chemically synthesized
tagccattctgacaattggtag

SEQ ID NO: 1394520 - DNA, 22 bp, Artificial Sequence
  chemically synthesized
gccattctgacaattggtagat

SEQ ID NO: 1394521 - DNA, 22 bp, Artificial Sequence
  chemically synthesized
tgacaattggtagatgttttac

SEQ ID NO: 1394522 - DNA, 22 bp, Artificial Sequence
  chemically synthesized
acaattggtagatgttttacat

SEQ ID NO: 1394523 - DNA, 22 bp, Artificial Sequence
  chemically synthesized
gtagatgttttacattgtcctt

SEQ ID NO: 1394524 - DNA, 22 bp, Artificial Sequence
  chemically synthesized
tacattgtccttttttacatac

SEQ ID NO: 1394525 - DNA, 22 bp, Artificial Sequence
  chemically synthesized
acattgtccttttttacatact

SEQ ID NO: 1394526 - DNA, 22 bp, Artificial Sequence
  chemically synthesized
cattgtccttttttacatactg

SEQ ID NO: 1394527 - DNA, 22 bp, Artificial Sequence
  chemically synthesized
aagtcgaaaatatcagcagtat

SEQ ID NO: 1394528 - DNA, 22 bp, Artificial Sequence
  chemically synthesized
tccttttttacatactgctgat

SEQ ID NO: 1394529 - DNA, 22 bp, Artificial Sequence
  chemically synthesized
ttttacatactgctgatatttt

SEQ ID NO: 1394530 - DNA, 22 bp, Artificial Sequence
  chemically synthesized
tttacatactgctgatattttc

SEQ ID NO: 1394531 - DNA, 22 bp, Artificial Sequence
  chemically synthesized
ttacatactgctgatattttcg

SEQ ID NO: 1394532 - DNA, 22 bp, Artificial Sequence
  chemically synthesized
tacatactgctgatattttcga

SEQ ID NO: 1394533 - DNA, 22 bp, Artificial Sequence
  chemically synthesized
acatactgctgatattttcgac

SEQ ID NO: 1394534 - DNA, 22 bp, Artificial Sequence
  chemically synthesized
catactgctgatattttcgact

SEQ ID NO: 1394535 - DNA, 22 bp, Artificial Sequence
  chemically synthesized
ctgatattttcgactttaactt

SEQ ID NO: 1394536 - DNA, 22 bp, Artificial Sequence
  chemically synthesized
atattttcgactttaacttttc

SEQ ID NO: 1394537 - DNA, 22 bp, Artificial Sequence
  chemically synthesized
taaaaatggcatggaggaaaag

SEQ ID NO: 1394538 - DNA, 22 bp, Artificial Sequence
  chemically synthesized
tcgactttaacttttcctccat

SEQ ID NO: 1394539 - DNA, 22 bp, Artificial Sequence
  chemically synthesized
cgactttaacttttcctccatg

SEQ ID NO: 1394540 - DNA, 22 bp, Artificial Sequence
  chemically synthesized
gactttaacttttcctccatgc

SEQ ID NO: 1394541 - DNA, 22 bp, Artificial Sequence
  chemically synthesized
taattgtaaaaatggcatggag

SEQ ID NO: 1394542 - DNA, 22 bp, Artificial Sequence
  chemically synthesized
taacttttcctccatgccattt

SEQ ID NO: 1394543 - DNA, 22 bp, Artificial Sequence
  chemically synthesized
aacttttcctccatgccatttt

SEQ ID NO: 1394544 - DNA, 22 bp, Artificial Sequence
  chemically synthesized
acttttcctccatgccattttt

SEQ ID NO: 1394545 - DNA, 22 bp, Artificial Sequence
  chemically synthesized
aaactgtaattgtaaaaatggc

SEQ ID NO: 1394546 - DNA, 22 bp, Artificial Sequence
  chemically synthesized
ttcctccatgccatttttacaa

SEQ ID NO: 1394547 - DNA, 22 bp, Artificial Sequence
  chemically synthesized
ttcaaactgtaattgtaaaaat

SEQ ID NO: 1394548 - DNA, 22 bp, Artificial Sequence
  chemically synthesized
tcctccatgccatttttacaat

SEQ ID NO: 1394549 - DNA, 22 bp, Artificial Sequence
  chemically synthesized
attcaaactgtaattgtaaaaa

SEQ ID NO: 1394550 - DNA, 22 bp, Artificial Sequence
  chemically synthesized
cctccatgccatttttacaatt

SEQ ID NO: 1394551 - DNA, 22 bp, Artificial Sequence
  chemically synthesized
ctccatgccatttttacaatta

SEQ ID NO: 1394552 - DNA, 22 bp, Artificial Sequence
  chemically synthesized
catgccatttttacaattacag

SEQ ID NO: 1394553 - DNA, 22 bp, Artificial Sequence
  chemically synthesized
aaatttattcaaactgtaattg

SEQ ID NO: 1394554 - DNA, 22 bp, Artificial Sequence
  chemically synthesized
ttaaaatttattcaaactgtaa

SEQ ID NO: 1394555 - DNA, 22 bp, Artificial Sequence
  chemically synthesized
tattattaaaatttattcaaac

SEQ ID NO: 1394556 - DNA, 22 bp, Artificial Sequence
  chemically synthesized
ttacaattacagtttgaataaa

SEQ ID NO: 1394557 - DNA, 22 bp, Artificial Sequence
  chemically synthesized
atattattaaaatttattcaaa

SEQ ID NO: 1394558 - DNA, 22 bp, Artificial Sequence
  chemically synthesized
tacaattacagtttgaataaat

SEQ ID NO: 1394559 - DNA, 22 bp, Artificial Sequence
  chemically synthesized
tatattattaaaatttattcaa

SEQ ID NO: 1394560 - DNA, 22 bp, Artificial Sequence
  chemically synthesized
acaattacagtttgaataaatt

SEQ ID NO: 1394561 - DNA, 22 bp, Artificial Sequence
  chemically synthesized
ttatattattaaaatttattca

SEQ ID NO: 1394562 - DNA, 22 bp, Artificial Sequence
  chemically synthesized
caattacagtttgaataaattt

SEQ ID NO: 1394563 - DNA, 22 bp, Artificial Sequence
  chemically synthesized
cagtttgaataaattttaataa

SEQ ID NO: 1394564 - DNA, 22 bp, Artificial Sequence
  chemically synthesized
aagaagagacttttatattatt

SEQ ID NO: 1394565 - DNA, 22 bp, Artificial Sequence
  chemically synthesized
gaataaattttaataatataaa

SEQ ID NO: 1394566 - DNA, 22 bp, Artificial Sequence
  chemically synthesized
aataaattttaataatataaaa

SEQ ID NO: 1394567 - DNA, 22 bp, Artificial Sequence
  chemically synthesized
taataatataaaagtctcttct

SEQ ID NO: 1394568 - DNA, 22 bp, Artificial Sequence
  chemically synthesized
aataatataaaagtctcttctt

SEQ ID NO: 1394569 - DNA, 22 bp, Artificial Sequence
  chemically synthesized
ataatataaaagtctcttcttg

SEQ ID NO: 1394570 - DNA, 22 bp, Artificial Sequence
  chemically synthesized
ttcttgaattttgactctctcc

SEQ ID NO: 1394571 - DNA, 22 bp, Artificial Sequence
  chemically synthesized
cttgaattttgactctctccac

SEQ ID NO: 1394572 - DNA, 22 bp, Artificial Sequence
  chemically synthesized
ttgaattttgactctctccact

SEQ ID NO: 1394573 - DNA, 22 bp, Artificial Sequence
  chemically synthesized
gaattttgactctctccacttt

SEQ ID NO: 1394574 - DNA, 22 bp, Artificial Sequence
  chemically synthesized
aattttgactctctccactttc

SEQ ID NO: 1394575 - DNA, 22 bp, Artificial Sequence
  chemically synthesized
tgactctctccactttcccatt

SEQ ID NO: 1394576 - DNA, 22 bp, Artificial Sequence
  chemically synthesized
gactctctccactttcccattc

SEQ ID NO: 1394577 - DNA, 22 bp, Artificial Sequence
  chemically synthesized
actctctccactttcccattca

SEQ ID NO: 1394578 - DNA, 22 bp, Artificial Sequence
  chemically synthesized
tctccactttcccattcacctt

SEQ ID NO: 1394579 - DNA, 22 bp, Artificial Sequence
  chemically synthesized
tccactttcccattcaccttga

SEQ ID NO: 1394580 - DNA, 22 bp, Artificial Sequence
  chemically synthesized
cactttcccattcaccttgatg

SEQ ID NO: 1394581 - DNA, 22 bp, Artificial Sequence
  chemically synthesized
aaggatcatcggaaacatcaag

SEQ ID NO: 1394582 - DNA, 22 bp, Artificial Sequence
  chemically synthesized
tcccattcaccttgatgtttcc

SEQ ID NO: 1394583 - DNA, 22 bp, Artificial Sequence
  chemically synthesized
cccattcaccttgatgtttccg

SEQ ID NO: 1394584 - DNA, 22 bp, Artificial Sequence
  chemically synthesized
ccattcaccttgatgtttccga

SEQ ID NO: 1394585 - DNA, 22 bp, Artificial Sequence
  chemically synthesized
ccacagttaaaggatcatcgga

SEQ ID NO: 1394586 - DNA, 22 bp, Artificial Sequence
  chemically synthesized
accttgatgtttccgatgatcc

SEQ ID NO: 1394587 - DNA, 22 bp, Artificial Sequence
  chemically synthesized
ctaccacagttaaaggatcatc

SEQ ID NO: 1394588 - DNA, 22 bp, Artificial Sequence
  chemically synthesized
gatgtttccgatgatcctttaa

SEQ ID NO: 1394589 - DNA, 22 bp, Artificial Sequence
  chemically synthesized
atgtttccgatgatcctttaac

SEQ ID NO: 1394590 - DNA, 22 bp, Artificial Sequence
  chemically synthesized
ccgatgatcctttaactgtggt

SEQ ID NO: 1394591 - DNA, 22 bp, Artificial Sequence
  chemically synthesized
agtgcaactgctaccacagtta

SEQ ID NO: 1394592 - DNA, 22 bp, Artificial Sequence
  chemically synthesized
cgatgatcctttaactgtggta

SEQ ID NO: 1394593 - DNA, 22 bp, Artificial Sequence
  chemically synthesized
aagtgcaactgctaccacagtt

SEQ ID NO: 1394594 - DNA, 22 bp, Artificial Sequence
  chemically synthesized
tttaagtgcaactgctaccaca

SEQ ID NO: 1394595 - DNA, 22 bp, Artificial Sequence
  chemically synthesized
taactgtggtagcagttgcact

SEQ ID NO: 1394596 - DNA, 22 bp, Artificial Sequence
  chemically synthesized
aactgtggtagcagttgcactt

SEQ ID NO: 1394597 - DNA, 22 bp, Artificial Sequence
  chemically synthesized
actgtggtagcagttgcactta

SEQ ID NO: 1394598 - DNA, 22 bp, Artificial Sequence
  chemically synthesized
cagcatgctatttaagtgcaac

SEQ ID NO: 1394599 - DNA, 22 bp, Artificial Sequence
  chemically synthesized
gcagcatgctatttaagtgcaa

SEQ ID NO: 1394600 - DNA, 22 bp, Artificial Sequence
  chemically synthesized
tggtagcagttgcacttaaata

SEQ ID NO: 1394601 - DNA, 22 bp, Artificial Sequence
  chemically synthesized
taggatttgcagcatgctattt

SEQ ID NO: 1394602 - DNA, 22 bp, Artificial Sequence
  chemically synthesized
acactgtaggatttgcagcatg

SEQ ID NO: 1394603 - DNA, 22 bp, Artificial Sequence
  chemically synthesized
cacttaaatagcatgctgcaaa

SEQ ID NO: 1394604 - DNA, 22 bp, Artificial Sequence
  chemically synthesized
tcacactgtaggatttgcagca

SEQ ID NO: 1394605 - DNA, 22 bp, Artificial Sequence
  chemically synthesized
aaatagcatgctgcaaatccta

SEQ ID NO: 1394606 - DNA, 22 bp, Artificial Sequence
  chemically synthesized
aatagcatgctgcaaatcctac

SEQ ID NO: 1394607 - DNA, 22 bp, Artificial Sequence
  chemically synthesized
caaatcctacagtgtgagagct

SEQ ID NO: 1394608 - DNA, 22 bp, Artificial Sequence
  chemically synthesized
acataaagaaagaaagagctct

SEQ ID NO: 1394609 - DNA, 22 bp, Artificial Sequence
  chemically synthesized
aacataaagaaagaaagagctc

SEQ ID NO: 1394610 - DNA, 22 bp, Artificial Sequence
  chemically synthesized
cagtgtgagagctctttctttc

SEQ ID NO: 1394611 - DNA, 22 bp, Artificial Sequence
  chemically synthesized
gaaatttaacataaagaaagaa

SEQ ID NO: 1394612 - DNA, 22 bp, Artificial Sequence
  chemically synthesized
agaaatttaacataaagaaaga

SEQ ID NO: 1394613 - DNA, 22 bp, Artificial Sequence
  chemically synthesized
tttctttctttatgttaaattt

SEQ ID NO: 1394614 - DNA, 22 bp, Artificial Sequence
  chemically synthesized
tctttctttatgttaaatttct

SEQ ID NO: 1394615 - DNA, 22 bp, Artificial Sequence
  chemically synthesized
ctttctttatgttaaatttcta

SEQ ID NO: 1394616 - DNA, 22 bp, Artificial Sequence
  chemically synthesized
gtggatacagtttagaaattta

SEQ ID NO: 1394617 - DNA, 22 bp, Artificial Sequence
  chemically synthesized
tttctttatgttaaatttctaa

SEQ ID NO: 1394618 - DNA, 22 bp, Artificial Sequence
  chemically synthesized
tagtggatacagtttagaaatt

SEQ ID NO: 1394619 - DNA, 22 bp, Artificial Sequence
  chemically synthesized
tctttatgttaaatttctaaac

SEQ ID NO: 1394620 - DNA, 22 bp, Artificial Sequence
  chemically synthesized
ctttatgttaaatttctaaact

SEQ ID NO: 1394621 - DNA, 22 bp, Artificial Sequence
  chemically synthesized
tttatgttaaatttctaaactg

SEQ ID NO: 1394622 - DNA, 22 bp, Artificial Sequence
  chemically synthesized
tctctagtggatacagtttaga

SEQ ID NO: 1394623 - DNA, 22 bp, Artificial Sequence
  chemically synthesized
tatgttaaatttctaaactgta

SEQ ID NO: 1394624 - DNA, 22 bp, Artificial Sequence
  chemically synthesized
atgttaaatttctaaactgtat

SEQ ID NO: 1394625 - DNA, 22 bp, Artificial Sequence
  chemically synthesized
tgttaaatttctaaactgtatc

SEQ ID NO: 1394626 - DNA, 22 bp, Artificial Sequence
  chemically synthesized
agctgtctctagtggatacagt

SEQ ID NO: 1394627 - DNA, 22 bp, Artificial Sequence
  chemically synthesized
tgagctgtctctagtggataca

SEQ ID NO: 1394628 - DNA, 22 bp, Artificial Sequence
  chemically synthesized
aatttctaaactgtatccacta

SEQ ID NO: 1394629 - DNA, 22 bp, Artificial Sequence
  chemically synthesized
ctgagctgtctctagtggatac

SEQ ID NO: 1394630 - DNA, 22 bp, Artificial Sequence
  chemically synthesized
ttctgagctgtctctagtggat

SEQ ID NO: 1394631 - DNA, 22 bp, Artificial Sequence
  chemically synthesized
ctaaactgtatccactagagac

SEQ ID NO: 1394632 - DNA, 22 bp, Artificial Sequence
  chemically synthesized
taaactgtatccactagagaca

SEQ ID NO: 1394633 - DNA, 22 bp, Artificial Sequence
  chemically synthesized
tctcttctgagctgtctctagt

SEQ ID NO: 1394634 - DNA, 22 bp, Artificial Sequence
  chemically synthesized
aactgtatccactagagacagc

SEQ ID NO: 1394635 - DNA, 22 bp, Artificial Sequence
  chemically synthesized
attgtctcttctgagctgtctc

SEQ ID NO: 1394636 - DNA, 22 bp, Artificial Sequence
  chemically synthesized
tatccactagagacagctcaga

SEQ ID NO: 1394637 - DNA, 22 bp, Artificial Sequence
  chemically synthesized
gtattcattgtctcttctgagc

SEQ ID NO: 1394638 - DNA, 22 bp, Artificial Sequence
  chemically synthesized
attagtattcattgtctcttct

SEQ ID NO: 1394639 - DNA, 22 bp, Artificial Sequence
  chemically synthesized
gattagtattcattgtctcttc

SEQ ID NO: 1394640 - DNA, 22 bp, Artificial Sequence
  chemically synthesized
gagacagctcagaagagacaat

SEQ ID NO: 1394641 - DNA, 22 bp, Artificial Sequence
  chemically synthesized
tgattagtattcattgtctctt

SEQ ID NO: 1394642 - DNA, 22 bp, Artificial Sequence
  chemically synthesized
ttgattagtattcattgtctct

SEQ ID NO: 1394643 - DNA, 22 bp, Artificial Sequence
  chemically synthesized
ttttgattagtattcattgtct

SEQ ID NO: 1394644 - DNA, 22 bp, Artificial Sequence
  chemically synthesized
tcttttgattagtattcattgt

SEQ ID NO: 1394645 - DNA, 22 bp, Artificial Sequence
  chemically synthesized
ctcttttgattagtattcattg

SEQ ID NO: 1394646 - DNA, 22 bp, Artificial Sequence
  chemically synthesized
tctcttttgattagtattcatt

SEQ ID NO: 1394647 - DNA, 22 bp, Artificial Sequence
  chemically synthesized
tttctcttttgattagtattca

SEQ ID NO: 1394648 - DNA, 22 bp, Artificial Sequence
  chemically synthesized
agaagagacaatgaatactaat

SEQ ID NO: 1394649 - DNA, 22 bp, Artificial Sequence
  chemically synthesized
atcaaaagagaaagaatcactt

SEQ ID NO: 1394650 - DNA, 22 bp, Artificial Sequence
  chemically synthesized
aggcgtgaccacaaccaagtga

SEQ ID NO: 1394651 - DNA, 22 bp, Artificial Sequence
  chemically synthesized
ctaaggcgtgaccacaaccaag

SEQ ID NO: 1394652 - DNA, 22 bp, Artificial Sequence
  chemically synthesized
gctaaggcgtgaccacaaccaa

SEQ ID NO: 1394653 - DNA, 22 bp, Artificial Sequence
  chemically synthesized
ttgctaaggcgtgaccacaacc

SEQ ID NO: 1394654 - DNA, 22 bp, Artificial Sequence
  chemically synthesized
cttgctaaggcgtgaccacaac

SEQ ID NO: 1394655 - DNA, 22 bp, Artificial Sequence
  chemically synthesized
ggttgtggtcacgccttagcaa

SEQ ID NO: 1394656 - DNA, 22 bp, Artificial Sequence
  chemically synthesized
gttgtggtcacgccttagcaag

SEQ ID NO: 1394657 - DNA, 22 bp, Artificial Sequence
  chemically synthesized
gtaaaggggtttcttgctaagg

SEQ ID NO: 1394658 - DNA, 22 bp, Artificial Sequence
  chemically synthesized
tggtaaaggggtttcttgctaa

SEQ ID NO: 1394659 - DNA, 22 bp, Artificial Sequence
  chemically synthesized
ctggtaaaggggtttcttgcta

SEQ ID NO: 1394660 - DNA, 22 bp, Artificial Sequence
  chemically synthesized
tggtcacgccttagcaagaaac

SEQ ID NO: 1394661 - DNA, 22 bp, Artificial Sequence
  chemically synthesized
tctggtaaaggggtttcttgct

SEQ ID NO: 1394662 - DNA, 22 bp, Artificial Sequence
  chemically synthesized
ttctggtaaaggggtttcttgc

SEQ ID NO: 1394663 - DNA, 22 bp, Artificial Sequence
  chemically synthesized
tcttttctggtaaaggggtttc

SEQ ID NO: 1394664 - DNA, 22 bp, Artificial Sequence
  chemically synthesized
agcaagaaacccctttaccaga

SEQ ID NO: 1394665 - DNA, 22 bp, Artificial Sequence
  chemically synthesized
gcaagaaacccctttaccagaa

SEQ ID NO: 1394666 - DNA, 22 bp, Artificial Sequence
  chemically synthesized
taccagaaaagacaactgtttt

SEQ ID NO: 1394667 - DNA, 22 bp, Artificial Sequence
  chemically synthesized
accagaaaagacaactgtttta

SEQ ID NO: 1394668 - DNA, 22 bp, Artificial Sequence
  chemically synthesized
ccagaaaagacaactgttttac

SEQ ID NO: 1394669 - DNA, 22 bp, Artificial Sequence
  chemically synthesized
ggaatatataggtagcatgtaa

SEQ ID NO: 1394670 - DNA, 22 bp, Artificial Sequence
  chemically synthesized
cactgggaatatataggtagca

SEQ ID NO: 1394671 - DNA, 22 bp, Artificial Sequence
  chemically synthesized
ccactgggaatatataggtagc

SEQ ID NO: 1394672 - DNA, 22 bp, Artificial Sequence
  chemically synthesized
tttccactgggaatatataggt

SEQ ID NO: 1394673 - DNA, 22 bp, Artificial Sequence
  chemically synthesized
ttttacatgctacctatatatt

SEQ ID NO: 1394674 - DNA, 22 bp, Artificial Sequence
  chemically synthesized
tacatgctacctatatattccc

SEQ ID NO: 1394675 - DNA, 22 bp, Artificial Sequence
  chemically synthesized
acatgctacctatatattccca

SEQ ID NO: 1394676 - DNA, 22 bp, Artificial Sequence
  chemically synthesized
catgctacctatatattcccag

SEQ ID NO: 1394677 - DNA, 22 bp, Artificial Sequence
  chemically synthesized
tgaagtggctgtttccactggg

SEQ ID NO: 1394678 - DNA, 22 bp, Artificial Sequence
  chemically synthesized
cctatatattcccagtggaaac

SEQ ID NO: 1394679 - DNA, 22 bp, Artificial Sequence
  chemically synthesized
tatattcccagtggaaacagcc

SEQ ID NO: 1394680 - DNA, 22 bp, Artificial Sequence
  chemically synthesized
aagtcgttgtgaagtggctgtt

SEQ ID NO: 1394681 - DNA, 22 bp, Artificial Sequence
  chemically synthesized
aaagtcgttgtgaagtggctgt

SEQ ID NO: 1394682 - DNA, 22 bp, Artificial Sequence
  chemically synthesized
taaagtcgttgtgaagtggctg

SEQ ID NO: 1394683 - DNA, 22 bp, Artificial Sequence
  chemically synthesized
ccagtggaaacagccacttcac

SEQ ID NO: 1394684 - DNA, 22 bp, Artificial Sequence
  chemically synthesized
actttaaagtcgttgtgaagtg

SEQ ID NO: 1394685 - DNA, 22 bp, Artificial Sequence
  chemically synthesized
cactttaaagtcgttgtgaagt

SEQ ID NO: 1394686 - DNA, 22 bp, Artificial Sequence
  chemically synthesized
atcttcactttaaagtcgttgt

SEQ ID NO: 1394687 - DNA, 22 bp, Artificial Sequence
  chemically synthesized
attcatcttcactttaaagtcg

SEQ ID NO: 1394688 - DNA, 22 bp, Artificial Sequence
  chemically synthesized
cacaacgactttaaagtgaaga

SEQ ID NO: 1394689 - DNA, 22 bp, Artificial Sequence
  chemically synthesized
acaacgactttaaagtgaagat

SEQ ID NO: 1394690 - DNA, 22 bp, Artificial Sequence
  chemically synthesized
taaagtgaagatgaatgagttt

SEQ ID NO: 1394691 - DNA, 22 bp, Artificial Sequence
  chemically synthesized
aaagtgaagatgaatgagtttt

SEQ ID NO: 1394692 - DNA, 22 bp, Artificial Sequence
  chemically synthesized
aagtgaagatgaatgagtttta

SEQ ID NO: 1394693 - DNA, 22 bp, Artificial Sequence
  chemically synthesized
tgcaccacaaaaaagcaatgat

SEQ ID NO: 1394694 - DNA, 22 bp, Artificial Sequence
  chemically synthesized
atgcaccacaaaaaagcaatga

SEQ ID NO: 1394695 - DNA, 22 bp, Artificial Sequence
  chemically synthesized
gtttatgcaccacaaaaaagca

SEQ ID NO: 1394696 - DNA, 22 bp, Artificial Sequence
  chemically synthesized
tatcattgcttttttgtggtgc

SEQ ID NO: 1394697 - DNA, 22 bp, Artificial Sequence
  chemically synthesized
atcattgcttttttgtggtgca

SEQ ID NO: 1394698 - DNA, 22 bp, Artificial Sequence
  chemically synthesized
aggtctagtttatgcaccacaa

SEQ ID NO: 1394699 - DNA, 22 bp, Artificial Sequence
  chemically synthesized
tcattgcttttttgtggtgcat

SEQ ID NO: 1394700 - DNA, 22 bp, Artificial Sequence
  chemically synthesized
caggtctagtttatgcaccaca

SEQ ID NO: 1394701 - DNA, 22 bp, Artificial Sequence
  chemically synthesized
cttttttgtggtgcataaacta

SEQ ID NO: 1394702 - DNA, 22 bp, Artificial Sequence
  chemically synthesized
gatagtttcaggtctagtttat

SEQ ID NO: 1394703 - DNA, 22 bp, Artificial Sequence
  chemically synthesized
ttttgtggtgcataaactagac

SEQ ID NO: 1394704 - DNA, 22 bp, Artificial Sequence
  chemically synthesized
tttgtggtgcataaactagacc

SEQ ID NO: 1394705 - DNA, 22 bp, Artificial Sequence
  chemically synthesized
ttgtggtgcataaactagacct

SEQ ID NO: 1394706 - DNA, 22 bp, Artificial Sequence
  chemically synthesized
tgtggtgcataaactagacctg

SEQ ID NO: 1394707 - DNA, 22 bp, Artificial Sequence
  chemically synthesized
gtggtgcataaactagacctga

SEQ ID NO: 1394708 - DNA, 22 bp, Artificial Sequence
  chemically synthesized
tggtgcataaactagacctgaa

SEQ ID NO: 1394709 - DNA, 22 bp, Artificial Sequence
  chemically synthesized
gacctgaaactatccagtattt

SEQ ID NO: 1394710 - DNA, 22 bp, Artificial Sequence
  chemically synthesized
aatgcaacaatcataaaatact

SEQ ID NO: 1394711 - DNA, 22 bp, Artificial Sequence
  chemically synthesized
aaactatccagtattttatgat

SEQ ID NO: 1394712 - DNA, 22 bp, Artificial Sequence
  chemically synthesized
catgttcaatgcaacaatcata

SEQ ID NO: 1394713 - DNA, 22 bp, Artificial Sequence
  chemically synthesized
gcatgttcaatgcaacaatcat

SEQ ID NO: 1394714 - DNA, 22 bp, Artificial Sequence
  chemically synthesized
tccagtattttatgattgttgc

SEQ ID NO: 1394715 - DNA, 22 bp, Artificial Sequence
  chemically synthesized
atttgcatgttcaatgcaacaa

SEQ ID NO: 1394716 - DNA, 22 bp, Artificial Sequence
  chemically synthesized
ctaatttgcatgttcaatgcaa

SEQ ID NO: 1394717 - DNA, 22 bp, Artificial Sequence
  chemically synthesized
gctaatttgcatgttcaatgca

SEQ ID NO: 1394718 - DNA, 22 bp, Artificial Sequence
  chemically synthesized
tatgattgttgcattgaacatg

SEQ ID NO: 1394719 - DNA, 22 bp, Artificial Sequence
  chemically synthesized
atgattgttgcattgaacatgc

SEQ ID NO: 1394720 - DNA, 22 bp, Artificial Sequence
  chemically synthesized
tgattgttgcattgaacatgca

SEQ ID NO: 1394721 - DNA, 22 bp, Artificial Sequence
  chemically synthesized
atatttgctaatttgcatgttc

SEQ ID NO: 1394722 - DNA, 22 bp, Artificial Sequence
  chemically synthesized
ttgcattgaacatgcaaattag

SEQ ID NO: 1394723 - DNA, 22 bp, Artificial Sequence
  chemically synthesized
cattgaacatgcaaattagcaa

SEQ ID NO: 1394724 - DNA, 22 bp, Artificial Sequence
  chemically synthesized
atcaaagctaatatttgctaat

SEQ ID NO: 1394725 - DNA, 22 bp, Artificial Sequence
  chemically synthesized
gatcaaagctaatatttgctaa

SEQ ID NO: 1394726 - DNA, 22 bp, Artificial Sequence
  chemically synthesized
aacatgcaaattagcaaatatt

SEQ ID NO: 1394727 - DNA, 22 bp, Artificial Sequence
  chemically synthesized
tggtatttgatcaaagctaata

SEQ ID NO: 1394728 - DNA, 22 bp, Artificial Sequence
  chemically synthesized
gcaaatattagctttgatcaaa

SEQ ID NO: 1394729 - DNA, 22 bp, Artificial Sequence
  chemically synthesized
ggtgtggctgtggtatttgatc

SEQ ID NO: 1394730 - DNA, 22 bp, Artificial Sequence
  chemically synthesized
tgggtgtggctgtggtatttga

SEQ ID NO: 1394731 - DNA, 22 bp, Artificial Sequence
  chemically synthesized
gctttgatcaaataccacagcc

SEQ ID NO: 1394732 - DNA, 22 bp, Artificial Sequence
  chemically synthesized
tgatcaaataccacagccacac

SEQ ID NO: 1394733 - DNA, 22 bp, Artificial Sequence
  chemically synthesized
gatcaaataccacagccacacc

SEQ ID NO: 1394734 - DNA, 22 bp, Artificial Sequence
  chemically synthesized
atcaaataccacagccacaccc

SEQ ID NO: 1394735 - DNA, 22 bp, Artificial Sequence
  chemically synthesized
gtacaagcattctgggtgtggc

SEQ ID NO: 1394736 - DNA, 22 bp, Artificial Sequence
  chemically synthesized
aactagtacaagcattctgggt

SEQ ID NO: 1394737 - DNA, 22 bp, Artificial Sequence
  chemically synthesized
aaactagtacaagcattctggg

SEQ ID NO: 1394738 - DNA, 22 bp, Artificial Sequence
  chemically synthesized
taaactagtacaagcattctgg

SEQ ID NO: 1394739 - DNA, 22 bp, Artificial Sequence
  chemically synthesized
ccaatgatggctttaaactagt

SEQ ID NO: 1394740 - DNA, 22 bp, Artificial Sequence
  chemically synthesized
gccaatgatggctttaaactag

SEQ ID NO: 1394741 - DNA, 22 bp, Artificial Sequence
  chemically synthesized
tgccaatgatggctttaaacta

SEQ ID NO: 1394742 - DNA, 22 bp, Artificial Sequence
  chemically synthesized
gcctttgccaatgatggcttta

SEQ ID NO: 1394743 - DNA, 22 bp, Artificial Sequence
  chemically synthesized
tggcctttgccaatgatggctt

SEQ ID NO: 1394744 - DNA, 22 bp, Artificial Sequence
  chemically synthesized
gtactagtttaaagccatcatt

SEQ ID NO: 1394745 - DNA, 22 bp, Artificial Sequence
  chemically synthesized
tactagtttaaagccatcattg

SEQ ID NO: 1394746 - DNA, 22 bp, Artificial Sequence
  chemically synthesized
gtttaaagccatcattggcaaa

SEQ ID NO: 1394747 - DNA, 22 bp, Artificial Sequence
  chemically synthesized
aaagccatcattggcaaaggcc

SEQ ID NO: 1394748 - DNA, 22 bp, Artificial Sequence
  chemically synthesized
aagccatcattggcaaaggcca

SEQ ID NO: 1394749 - DNA, 22 bp, Artificial Sequence
  chemically synthesized
aaaacaaagaattctggccttt

SEQ ID NO: 1394750 - DNA, 22 bp, Artificial Sequence
  chemically synthesized
attaaaaacaaagaattctggc

SEQ ID NO: 1394751 - DNA, 22 bp, Artificial Sequence
  chemically synthesized
cattaaaaacaaagaattctgg

SEQ ID NO: 1394752 - DNA, 22 bp, Artificial Sequence
  chemically synthesized
ttcattaaaaacaaagaattct

SEQ ID NO: 1394753 - DNA, 22 bp, Artificial Sequence
  chemically synthesized
gcaaaggccagaattctttgtt

SEQ ID NO: 1394754 - DNA, 22 bp, Artificial Sequence
  chemically synthesized
tatgttcttcattaaaaacaaa

SEQ ID NO: 1394755 - DNA, 22 bp, Artificial Sequence
  chemically synthesized
tgggaattatatgttcttcatt

SEQ ID NO: 1394756 - DNA, 22 bp, Artificial Sequence
  chemically synthesized
atgggaattatatgttcttcat

SEQ ID NO: 1394757 - DNA, 22 bp, Artificial Sequence
  chemically synthesized
tatgggaattatatgttcttca

SEQ ID NO: 1394758 - DNA, 22 bp, Artificial Sequence
  chemically synthesized
tttgtttttaatgaagaacata

SEQ ID NO: 1394759 - DNA, 22 bp, Artificial Sequence
  chemically synthesized
tgtttttaatgaagaacatata

SEQ ID NO: 1394760 - DNA, 22 bp, Artificial Sequence
  chemically synthesized
gtttttaatgaagaacatataa

SEQ ID NO: 1394761 - DNA, 22 bp, Artificial Sequence
  chemically synthesized
tttttaatgaagaacatataat

SEQ ID NO: 1394762 - DNA, 22 bp, Artificial Sequence
  chemically synthesized
atgcctttatgggaattatatg

SEQ ID NO: 1394763 - DNA, 22 bp, Artificial Sequence
  chemically synthesized
ttaatgaagaacatataattcc

SEQ ID NO: 1394764 - DNA, 22 bp, Artificial Sequence
  chemically synthesized
taatgaagaacatataattccc

SEQ ID NO: 1394765 - DNA, 22 bp, Artificial Sequence
  chemically synthesized
aatgaagaacatataattccca

SEQ ID NO: 1394766 - DNA, 22 bp, Artificial Sequence
  chemically synthesized
atgaagaacatataattcccat

SEQ ID NO: 1394767 - DNA, 22 bp, Artificial Sequence
  chemically synthesized
ataatctcatgcctttatggga

SEQ ID NO: 1394768 - DNA, 22 bp, Artificial Sequence
  chemically synthesized
acatgggtgcctgataatctca

SEQ ID NO: 1394769 - DNA, 22 bp, Artificial Sequence
  chemically synthesized
ccataaaggcatgagattatca

SEQ ID NO: 1394770 - DNA, 22 bp, Artificial Sequence
  chemically synthesized
atcatattgacatgggtgcctg

SEQ ID NO: 1394771 - DNA, 22 bp, Artificial Sequence
  chemically synthesized
acctgatcatattgacatgggt

SEQ ID NO: 1394772 - DNA, 22 bp, Artificial Sequence
  chemically synthesized
cacctgatcatattgacatggg

SEQ ID NO: 1394773 - DNA, 22 bp, Artificial Sequence
  chemically synthesized
tcacctgatcatattgacatgg

SEQ ID NO: 1394774 - DNA, 22 bp, Artificial Sequence
  chemically synthesized
tcaggcacccatgtcaatatga

SEQ ID NO: 1394775 - DNA, 22 bp, Artificial Sequence
  chemically synthesized
aggatgaaccagaagttttcac

SEQ ID NO: 1394776 - DNA, 22 bp, Artificial Sequence
  chemically synthesized
gttgaggatgaaccagaagttt

SEQ ID NO: 1394777 - DNA, 22 bp, Artificial Sequence
  chemically synthesized
ctggttcatcctcaactaacct

SEQ ID NO: 1394778 - DNA, 22 bp, Artificial Sequence
  chemically synthesized
tggttcatcctcaactaacctt

SEQ ID NO: 1394779 - DNA, 22 bp, Artificial Sequence
  chemically synthesized
gttcatcctcaactaacctttt

SEQ ID NO: 1394780 - DNA, 22 bp, Artificial Sequence
  chemically synthesized
atcagcaagataggaaaaggtt

SEQ ID NO: 1394781 - DNA, 22 bp, Artificial Sequence
  chemically synthesized
atcctcaactaaccttttccta

SEQ ID NO: 1394782 - DNA, 22 bp, Artificial Sequence
  chemically synthesized
ctcatcagcaagataggaaaag

SEQ ID NO: 1394783 - DNA, 22 bp, Artificial Sequence
  chemically synthesized
cctcatcagcaagataggaaaa

SEQ ID NO: 1394784 - DNA, 22 bp, Artificial Sequence
  chemically synthesized
tcctcatcagcaagataggaaa

SEQ ID NO: 1394785 - DNA, 22 bp, Artificial Sequence
  chemically synthesized
aactaaccttttcctatcttgc

SEQ ID NO: 1394786 - DNA, 22 bp, Artificial Sequence
  chemically synthesized
aattttcctcatcagcaagata

SEQ ID NO: 1394787 - DNA, 22 bp, Artificial Sequence
  chemically synthesized
accttttcctatcttgctgatg

SEQ ID NO: 1394788 - DNA, 22 bp, Artificial Sequence
  chemically synthesized
gtattaaattttcctcatcagc

SEQ ID NO: 1394789 - DNA, 22 bp, Artificial Sequence
  chemically synthesized
agtattaaattttcctcatcag

SEQ ID NO: 1394790 - DNA, 22 bp, Artificial Sequence
  chemically synthesized
ttcctatcttgctgatgaggaa

SEQ ID NO: 1394791 - DNA, 22 bp, Artificial Sequence
  chemically synthesized
tcctatcttgctgatgaggaaa

SEQ ID NO: 1394792 - DNA, 22 bp, Artificial Sequence
  chemically synthesized
cctatcttgctgatgaggaaaa

SEQ ID NO: 1394793 - DNA, 22 bp, Artificial Sequence
  chemically synthesized
ctatcttgctgatgaggaaaat

SEQ ID NO: 1394794 - DNA, 22 bp, Artificial Sequence
  chemically synthesized
gcttagtattaaattttcctca

SEQ ID NO: 1394795 - DNA, 22 bp, Artificial Sequence
  chemically synthesized
tcttgctgatgaggaaaattta

SEQ ID NO: 1394796 - DNA, 22 bp, Artificial Sequence
  chemically synthesized
gctgatgaggaaaatttaatac

SEQ ID NO: 1394797 - DNA, 22 bp, Artificial Sequence
  chemically synthesized
ctgatgaggaaaatttaatact

SEQ ID NO: 1394798 - DNA, 22 bp, Artificial Sequence
  chemically synthesized
cacagttagcttagtattaaat

SEQ ID NO: 1394799 - DNA, 22 bp, Artificial Sequence
  chemically synthesized
atgaggaaaatttaatactaag

SEQ ID NO: 1394800 - DNA, 22 bp, Artificial Sequence
  chemically synthesized
tctccacagttagcttagtatt

SEQ ID NO: 1394801 - DNA, 22 bp, Artificial Sequence
  chemically synthesized
gtctccacagttagcttagtat

SEQ ID NO: 1394802 - DNA, 22 bp, Artificial Sequence
  chemically synthesized
tagtttgtctccacagttagct

SEQ ID NO: 1394803 - DNA, 22 bp, Artificial Sequence
  chemically synthesized
aatactaagctaactgtggaga

SEQ ID NO: 1394804 - DNA, 22 bp, Artificial Sequence
  chemically synthesized
atactaagctaactgtggagac

SEQ ID NO: 1394805 - DNA, 22 bp, Artificial Sequence
  chemically synthesized
caaagagttatagtttgtctcc

SEQ ID NO: 1394806 - DNA, 22 bp, Artificial Sequence
  chemically synthesized
agctaactgtggagacaaacta

SEQ ID NO: 1394807 - DNA, 22 bp, Artificial Sequence
  chemically synthesized
actgtggagacaaactataact

SEQ ID NO: 1394808 - DNA, 22 bp, Artificial Sequence
  chemically synthesized
tggagacaaactataactcttt

SEQ ID NO: 1394809 - DNA, 22 bp, Artificial Sequence
  chemically synthesized
taactctttgtaatgtttggat

SEQ ID NO: 1394810 - DNA, 22 bp, Artificial Sequence
  chemically synthesized
tttgtaatgtttggatgccata

SEQ ID NO: 1394811 - DNA, 22 bp, Artificial Sequence
  chemically synthesized
tgtaatgtttggatgccatact

SEQ ID NO: 1394812 - DNA, 22 bp, Artificial Sequence
  chemically synthesized
gtaatgtttggatgccatactg

SEQ ID NO: 1394813 - DNA, 22 bp, Artificial Sequence
  chemically synthesized
taatgtttggatgccatactgt

SEQ ID NO: 1394814 - DNA, 22 bp, Artificial Sequence
  chemically synthesized
agaagacacaaacaatcacagt

SEQ ID NO: 1394815 - DNA, 22 bp, Artificial Sequence
  chemically synthesized
gagaagacacaaacaatcacag

SEQ ID NO: 1394816 - DNA, 22 bp, Artificial Sequence
  chemically synthesized
ggatgccatactgtgattgttt

SEQ ID NO: 1394817 - DNA, 22 bp, Artificial Sequence
  chemically synthesized
gatgccatactgtgattgtttg

SEQ ID NO: 1394818 - DNA, 22 bp, Artificial Sequence
  chemically synthesized
aacatatgaagtttgagaagac

SEQ ID NO: 1394819 - DNA, 22 bp, Artificial Sequence
  chemically synthesized
tgattgtttgtgtcttctcaaa

SEQ ID NO: 1394820 - DNA, 22 bp, Artificial Sequence
  chemically synthesized
gaattcaacatatgaagtttga

SEQ ID NO: 1394821 - DNA, 22 bp, Artificial Sequence
  chemically synthesized
tttgtgtcttctcaaacttcat

SEQ ID NO: 1394822 - DNA, 22 bp, Artificial Sequence
  chemically synthesized
gtgtcttctcaaacttcatatg

SEQ ID NO: 1394823 - DNA, 22 bp, Artificial Sequence
  chemically synthesized
tgtcttctcaaacttcatatgt

SEQ ID NO: 1394824 - DNA, 22 bp, Artificial Sequence
  chemically synthesized
gtgattagaattcaacatatga

SEQ ID NO: 1394825 - DNA, 22 bp, Artificial Sequence
  chemically synthesized
ggtgattagaattcaacatatg

SEQ ID NO: 1394826 - DNA, 22 bp, Artificial Sequence
  chemically synthesized
ctcaaacttcatatgttgaatt

SEQ ID NO: 1394827 - DNA, 22 bp, Artificial Sequence
  chemically synthesized
tcaaacttcatatgttgaattc

SEQ ID NO: 1394828 - DNA, 22 bp, Artificial Sequence
  chemically synthesized
aaacttcatatgttgaattcta

SEQ ID NO: 1394829 - DNA, 22 bp, Artificial Sequence
  chemically synthesized
catatgttgaattctaatcacc

SEQ ID NO: 1394830 - DNA, 22 bp, Artificial Sequence
  chemically synthesized
atatgttgaattctaatcacca

SEQ ID NO: 1394831 - DNA, 22 bp, Artificial Sequence
  chemically synthesized
taatatagtcatcttggtgatt

SEQ ID NO: 1394832 - DNA, 22 bp, Artificial Sequence
  chemically synthesized
ataatatagtcatcttggtgat

SEQ ID NO: 1394833 - DNA, 22 bp, Artificial Sequence
  chemically synthesized
ccttataatatagtcatcttgg

SEQ ID NO: 1394834 - DNA, 22 bp, Artificial Sequence
  chemically synthesized
aattctaatcaccaagatgact

SEQ ID NO: 1394835 - DNA, 22 bp, Artificial Sequence
  chemically synthesized
taatcaccaagatgactatatt

SEQ ID NO: 1394836 - DNA, 22 bp, Artificial Sequence
  chemically synthesized
atcaccaagatgactatattat

SEQ ID NO: 1394837 - DNA, 22 bp, Artificial Sequence
  chemically synthesized
ccaaaggcactaccttataata

SEQ ID NO: 1394838 - DNA, 22 bp, Artificial Sequence
  chemically synthesized
tattataaggtagtgcctttgg

SEQ ID NO: 1394839 - DNA, 22 bp, Artificial Sequence
  chemically synthesized
atgacccaataaattcccaaag

SEQ ID NO: 1394840 - DNA, 22 bp, Artificial Sequence
  chemically synthesized
taaggtagtgcctttgggaatt

SEQ ID NO: 1394841 - DNA, 22 bp, Artificial Sequence
  chemically synthesized
tgggaatttattgggtcatgag

SEQ ID NO: 1394842 - DNA, 22 bp, Artificial Sequence
  chemically synthesized
gggaatttattgggtcatgagg

SEQ ID NO: 1394843 - DNA, 22 bp, Artificial Sequence
  chemically synthesized
ggaatttattgggtcatgaggg

SEQ ID NO: 1394844 - DNA, 22 bp, Artificial Sequence
  chemically synthesized
atgaaggtagagccctcatgac

SEQ ID NO: 1394845 - DNA, 22 bp, Artificial Sequence
  chemically synthesized
attgggtcatgagggctctacc

SEQ ID NO: 1394846 - DNA, 22 bp, Artificial Sequence
  chemically synthesized
ttgggtcatgagggctctacct

SEQ ID NO: 1394847 - DNA, 22 bp, Artificial Sequence
  chemically synthesized
atcccattcatgaaggtagagc

SEQ ID NO: 1394848 - DNA, 22 bp, Artificial Sequence
  chemically synthesized
ggtcatgagggctctaccttca

SEQ ID NO: 1394849 - DNA, 22 bp, Artificial Sequence
  chemically synthesized
taagggcattaatcccattcat

SEQ ID NO: 1394850 - DNA, 22 bp, Artificial Sequence
  chemically synthesized
ataagggcattaatcccattca

SEQ ID NO: 1394851 - DNA, 22 bp, Artificial Sequence
  chemically synthesized
ttataagggcattaatcccatt

SEQ ID NO: 1394852 - DNA, 22 bp, Artificial Sequence
  chemically synthesized
taccttcatgaatgggattaat

SEQ ID NO: 1394853 - DNA, 22 bp, Artificial Sequence
  chemically synthesized
tcttataagggcattaatccca

SEQ ID NO: 1394854 - DNA, 22 bp, Artificial Sequence
  chemically synthesized
ccttcatgaatgggattaatgc

SEQ ID NO: 1394855 - DNA, 22 bp, Artificial Sequence
  chemically synthesized
catgaatgggattaatgccctt

SEQ ID NO: 1394856 - DNA, 22 bp, Artificial Sequence
  chemically synthesized
ggcctctcttataagggcatta

SEQ ID NO: 1394857 - DNA, 22 bp, Artificial Sequence
  chemically synthesized
atgaatgggattaatgccctta

SEQ ID NO: 1394858 - DNA, 22 bp, Artificial Sequence
  chemically synthesized
gggcctctcttataagggcatt

SEQ ID NO: 1394859 - DNA, 22 bp, Artificial Sequence
  chemically synthesized
ttgggcctctcttataagggca

SEQ ID NO: 1394860 - DNA, 22 bp, Artificial Sequence
  chemically synthesized
caaggcctcttgggcctctctt

SEQ ID NO: 1394861 - DNA, 22 bp, Artificial Sequence
  chemically synthesized
ccaaggcctcttgggcctctct

SEQ ID NO: 1394862 - DNA, 22 bp, Artificial Sequence
  chemically synthesized
atgcccttataagagaggccca

SEQ ID NO: 1394863 - DNA, 22 bp, Artificial Sequence
  chemically synthesized
agcttccaaggcctcttgggcc

SEQ ID NO: 1394864 - DNA, 22 bp, Artificial Sequence
  chemically synthesized
ataagagaggcccaagaggcct

SEQ ID NO: 1394865 - DNA, 22 bp, Artificial Sequence
  chemically synthesized
actgagcttccaaggcctcttg

SEQ ID NO: 1394866 - DNA, 22 bp, Artificial Sequence
  chemically synthesized
taagagaggcccaagaggcctt

SEQ ID NO: 1394867 - DNA, 22 bp, Artificial Sequence
  chemically synthesized
ggaagctcagtgagcgtgcctg

SEQ ID NO: 1394868 - DNA, 22 bp, Artificial Sequence
  chemically synthesized
aaggtcaaggtgcaggcacgct

SEQ ID NO: 1394869 - DNA, 22 bp, Artificial Sequence
  chemically synthesized
gaagctcagtgagcgtgcctgc

SEQ ID NO: 1394870 - DNA, 22 bp, Artificial Sequence
  chemically synthesized
agtgagcgtgcctgcaccttga

SEQ ID NO: 1394871 - DNA, 22 bp, Artificial Sequence
  chemically synthesized
tggaggcggggaagttcaaggt

SEQ ID NO: 1394872 - DNA, 22 bp, Artificial Sequence
  chemically synthesized
caccttgaccttgaacttcccc

SEQ ID NO: 1394873 - DNA, 22 bp, Artificial Sequence
  chemically synthesized
ccagttatggaggcggggaagt

SEQ ID NO: 1394874 - DNA, 22 bp, Artificial Sequence
  chemically synthesized
tcccagttatggaggcggggaa

SEQ ID NO: 1394875 - DNA, 22 bp, Artificial Sequence
  chemically synthesized
ctcccagttatggaggcgggga

SEQ ID NO: 1394876 - DNA, 22 bp, Artificial Sequence
  chemically synthesized
gaccttgaacttccccgcctcc

SEQ ID NO: 1394877 - DNA, 22 bp, Artificial Sequence
  chemically synthesized
accttgaacttccccgcctcca

SEQ ID NO: 1394878 - DNA, 22 bp, Artificial Sequence
  chemically synthesized
tttctcccagttatggaggcgg

SEQ ID NO: 1394879 - DNA, 22 bp, Artificial Sequence
  chemically synthesized
atttctcccagttatggaggcg

SEQ ID NO: 1394880 - DNA, 22 bp, Artificial Sequence
  chemically synthesized
gaacttccccgcctccataact

SEQ ID NO: 1394881 - DNA, 22 bp, Artificial Sequence
  chemically synthesized
aacttccccgcctccataactg

SEQ ID NO: 1394882 - DNA, 22 bp, Artificial Sequence
  chemically synthesized
ccccgcctccataactgggaga

SEQ ID NO: 1394883 - DNA, 22 bp, Artificial Sequence
  chemically synthesized
cccgcctccataactgggagaa

SEQ ID NO: 1394884 - DNA, 22 bp, Artificial Sequence
  chemically synthesized
taaagaacagaaatttatttct

SEQ ID NO: 1394885 - DNA, 22 bp, Artificial Sequence
  chemically synthesized
ataaagaacagaaatttatttc

SEQ ID NO: 1394886 - DNA, 22 bp, Artificial Sequence
  chemically synthesized
cataactgggagaaataaattt

SEQ ID NO: 1394887 - DNA, 22 bp, Artificial Sequence
  chemically synthesized
ggagaaataaatttctgttctt

SEQ ID NO: 1394888 - DNA, 22 bp, Artificial Sequence
  chemically synthesized
ctgttctttataagccaccctg

SEQ ID NO: 1394889 - DNA, 22 bp, Artificial Sequence
  chemically synthesized
tgttctttataagccaccctgt

SEQ ID NO: 1394890 - DNA, 22 bp, Artificial Sequence
  chemically synthesized
ttctttataagccaccctgttt

SEQ ID NO: 1394891 - DNA, 22 bp, Artificial Sequence
  chemically synthesized
tttataagccaccctgtttatg

SEQ ID NO: 1394892 - DNA, 22 bp, Artificial Sequence
  chemically synthesized
tataagccaccctgtttatggt

SEQ ID NO: 1394893 - DNA, 22 bp, Artificial Sequence
  chemically synthesized
ataagccaccctgtttatggta

SEQ ID NO: 1394894 - DNA, 22 bp, Artificial Sequence
  chemically synthesized
gtgtaacaaaaataccataaac

SEQ ID NO: 1394895 - DNA, 22 bp, Artificial Sequence
  chemically synthesized
taagccaccctgtttatggtat

SEQ ID NO: 1394896 - DNA, 22 bp, Artificial Sequence
  chemically synthesized
gactggtgtaacaaaaatacca

SEQ ID NO: 1394897 - DNA, 22 bp, Artificial Sequence
  chemically synthesized
agactggtgtaacaaaaatacc

SEQ ID NO: 1394898 - DNA, 22 bp, Artificial Sequence
  chemically synthesized
tagactggtgtaacaaaaatac

SEQ ID NO: 1394899 - DNA, 22 bp, Artificial Sequence
  chemically synthesized
ttagactggtgtaacaaaaata

SEQ ID NO: 1394900 - DNA, 22 bp, Artificial Sequence
  chemically synthesized
tttatggtatttttgttacacc

SEQ ID NO: 1394901 - DNA, 22 bp, Artificial Sequence
  chemically synthesized
gtccttttagactggtgtaaca

SEQ ID NO: 1394902 - DNA, 22 bp, Artificial Sequence
  chemically synthesized
agtccttttagactggtgtaac

SEQ ID NO: 1394903 - DNA, 22 bp, Artificial Sequence
  chemically synthesized
atggtatttttgttacaccagt

SEQ ID NO: 1394904 - DNA, 22 bp, Artificial Sequence
  chemically synthesized
tggtatttttgttacaccagtc

SEQ ID NO: 1394905 - DNA, 22 bp, Artificial Sequence
  chemically synthesized
ttgttacaccagtctaaaagga

SEQ ID NO: 1394906 - DNA, 22 bp, Artificial Sequence
  chemically synthesized
tgttacaccagtctaaaaggac

SEQ ID NO: 1394907 - DNA, 22 bp, Artificial Sequence
  chemically synthesized
gttacaccagtctaaaaggact

SEQ ID NO: 1394908 - DNA, 22 bp, Artificial Sequence
  chemically synthesized
ttacaccagtctaaaaggacta

SEQ ID NO: 1394909 - DNA, 22 bp, Artificial Sequence
  chemically synthesized
caccagtctaaaaggactaaga

SEQ ID NO: 1394910 - DNA, 22 bp, Artificial Sequence
  chemically synthesized
cccaaatcagtgtcttagtcct

SEQ ID NO: 1394911 - DNA, 22 bp, Artificial Sequence
  chemically synthesized
ccccaaatcagtgtcttagtcc

SEQ ID NO: 1394912 - DNA, 22 bp, Artificial Sequence
  chemically synthesized
aaaggactaagacactgatttg

SEQ ID NO: 1394913 - DNA, 22 bp, Artificial Sequence
  chemically synthesized
ccaaaatcttccccaaatcagt

SEQ ID NO: 1394914 - DNA, 22 bp, Artificial Sequence
  chemically synthesized
ctgccaaaatcttccccaaatc

SEQ ID NO: 1394915 - DNA, 22 bp, Artificial Sequence
  chemically synthesized
agacactgatttggggaagatt

SEQ ID NO: 1394916 - DNA, 22 bp, Artificial Sequence
  chemically synthesized
atttggggaagattttggcagt

SEQ ID NO: 1394917 - DNA, 22 bp, Artificial Sequence
  chemically synthesized
ggggaagattttggcagtaatt

SEQ ID NO: 1394918 - DNA, 22 bp, Artificial Sequence
  chemically synthesized
gggaagattttggcagtaattg

SEQ ID NO: 1394919 - DNA, 22 bp, Artificial Sequence
  chemically synthesized
tggcagtaattgctgtctcttt

SEQ ID NO: 1394920 - DNA, 22 bp, Artificial Sequence
  chemically synthesized
ggcagtaattgctgtctctttt

SEQ ID NO: 1394921 - DNA, 22 bp, Artificial Sequence
  chemically synthesized
gcagtaattgctgtctctttta

SEQ ID NO: 1394922 - DNA, 22 bp, Artificial Sequence
  chemically synthesized
gggaagagtatgtaaaagagac

SEQ ID NO: 1394923 - DNA, 22 bp, Artificial Sequence
  chemically synthesized
cattggggaagagtatgtaaaa

SEQ ID NO: 1394924 - DNA, 22 bp, Artificial Sequence
  chemically synthesized
acattggggaagagtatgtaaa

SEQ ID NO: 1394925 - DNA, 22 bp, Artificial Sequence
  chemically synthesized
ctgtctcttttacatactcttc

SEQ ID NO: 1394926 - DNA, 22 bp, Artificial Sequence
  chemically synthesized
tctcttttacatactcttcccc

SEQ ID NO: 1394927 - DNA, 22 bp, Artificial Sequence
  chemically synthesized
tagaagtttacattggggaaga

SEQ ID NO: 1394928 - DNA, 22 bp, Artificial Sequence
  chemically synthesized
ttttacatactcttccccaatg

SEQ ID NO: 1394929 - DNA, 22 bp, Artificial Sequence
  chemically synthesized
ttacatactcttccccaatgta

SEQ ID NO: 1394930 - DNA, 22 bp, Artificial Sequence
  chemically synthesized
tacatactcttccccaatgtaa

SEQ ID NO: 1394931 - DNA, 22 bp, Artificial Sequence
  chemically synthesized
gattatagaagtttacattggg

SEQ ID NO: 1394932 - DNA, 22 bp, Artificial Sequence
  chemically synthesized
acatactcttccccaatgtaaa

SEQ ID NO: 1394933 - DNA, 22 bp, Artificial Sequence
  chemically synthesized
catactcttccccaatgtaaac

SEQ ID NO: 1394934 - DNA, 22 bp, Artificial Sequence
  chemically synthesized
attagattatagaagtttacat

SEQ ID NO: 1394935 - DNA, 22 bp, Artificial Sequence
  chemically synthesized
gattagattatagaagtttaca

SEQ ID NO: 1394936 - DNA, 22 bp, Artificial Sequence
  chemically synthesized
ttccccaatgtaaacttctata

SEQ ID NO: 1394937 - DNA, 22 bp, Artificial Sequence
  chemically synthesized
ccttgattagattatagaagtt

SEQ ID NO: 1394938 - DNA, 22 bp, Artificial Sequence
  chemically synthesized
ccccaatgtaaacttctataat

SEQ ID NO: 1394939 - DNA, 22 bp, Artificial Sequence
  chemically synthesized
cccaatgtaaacttctataatc

SEQ ID NO: 1394940 - DNA, 22 bp, Artificial Sequence
  chemically synthesized
aactcccttgattagattatag

SEQ ID NO: 1394941 - DNA, 22 bp, Artificial Sequence
  chemically synthesized
aaactcccttgattagattata

SEQ ID NO: 1394942 - DNA, 22 bp, Artificial Sequence
  chemically synthesized
tgtttaaactcccttgattaga

SEQ ID NO: 1394943 - DNA, 22 bp, Artificial Sequence
  chemically synthesized
ttatgtttaaactcccttgatt

SEQ ID NO: 1394944 - DNA, 22 bp, Artificial Sequence
  chemically synthesized
ctataatctaatcaagggagtt

SEQ ID NO: 1394945 - DNA, 22 bp, Artificial Sequence
  chemically synthesized
tataatctaatcaagggagttt

SEQ ID NO: 1394946 - DNA, 22 bp, Artificial Sequence
  chemically synthesized
taatctaatcaagggagtttaa

SEQ ID NO: 1394947 - DNA, 22 bp, Artificial Sequence
  chemically synthesized
catggctattatgtttaaactc

SEQ ID NO: 1394948 - DNA, 22 bp, Artificial Sequence
  chemically synthesized
ttacatggctattatgtttaaa

SEQ ID NO: 1394949 - DNA, 22 bp, Artificial Sequence
  chemically synthesized
atcaagggagtttaaacataat

SEQ ID NO: 1394950 - DNA, 22 bp, Artificial Sequence
  chemically synthesized
tgtctgttacatggctattatg

SEQ ID NO: 1394951 - DNA, 22 bp, Artificial Sequence
  chemically synthesized
cactgtgtctgttacatggcta

SEQ ID NO: 1394952 - DNA, 22 bp, Artificial Sequence
  chemically synthesized
acactgtgtctgttacatggct

SEQ ID NO: 1394953 - DNA, 22 bp, Artificial Sequence
  chemically synthesized
tacactgtgtctgttacatggc

SEQ ID NO: 1394954 - DNA, 22 bp, Artificial Sequence
  chemically synthesized
aaacataatagccatgtaacag

SEQ ID NO: 1394955 - DNA, 22 bp, Artificial Sequence
  chemically synthesized
aacataatagccatgtaacaga

SEQ ID NO: 1394956 - DNA, 22 bp, Artificial Sequence
  chemically synthesized
atattttacactgtgtctgtta

SEQ ID NO: 1394957 - DNA, 22 bp, Artificial Sequence
  chemically synthesized
gatattttacactgtgtctgtt

SEQ ID NO: 1394958 - DNA, 22 bp, Artificial Sequence
  chemically synthesized
tgatattttacactgtgtctgt

SEQ ID NO: 1394959 - DNA, 22 bp, Artificial Sequence
  chemically synthesized
aaaaatctttgatattttacac

SEQ ID NO: 1394960 - DNA, 22 bp, Artificial Sequence
  chemically synthesized
aaaaaatctttgatattttaca

SEQ ID NO: 1394961 - DNA, 22 bp, Artificial Sequence
  chemically synthesized
catcttaaaaaatctttgatat

SEQ ID NO: 1394962 - DNA, 22 bp, Artificial Sequence
  chemically synthesized
tacatcttaaaaaatctttgat

SEQ ID NO: 1394963 - DNA, 22 bp, Artificial Sequence
  chemically synthesized
gttctacatcttaaaaaatctt

SEQ ID NO: 1394964 - DNA, 22 bp, Artificial Sequence
  chemically synthesized
acgcgactggttctacatctta

SEQ ID NO: 1394965 - DNA, 22 bp, Artificial Sequence
  chemically synthesized
tttaagatgtagaaccagtcgc

SEQ ID NO: 1394966 - DNA, 22 bp, Artificial Sequence
  chemically synthesized
ttaagatgtagaaccagtcgcg

SEQ ID NO: 1394967 - DNA, 22 bp, Artificial Sequence
  chemically synthesized
taagatgtagaaccagtcgcgt

SEQ ID NO: 1394968 - DNA, 22 bp, Artificial Sequence
  chemically synthesized
aagatgtagaaccagtcgcgtt

SEQ ID NO: 1394969 - DNA, 22 bp, Artificial Sequence
  chemically synthesized
agatgtagaaccagtcgcgtta

SEQ ID NO: 1394970 - DNA, 22 bp, Artificial Sequence
  chemically synthesized
aagccacaatactaacgcgact

SEQ ID NO: 1394971 - DNA, 22 bp, Artificial Sequence
  chemically synthesized
tccctgaagccacaatactaac

SEQ ID NO: 1394972 - DNA, 22 bp, Artificial Sequence
  chemically synthesized
taagaaatacattgtccctgaa

SEQ ID NO: 1394973 - DNA, 22 bp, Artificial Sequence
  chemically synthesized
gtattgtggcttcagggacaat

SEQ ID NO: 1394974 - DNA, 22 bp, Artificial Sequence
  chemically synthesized
ctataagaaatacattgtccct

SEQ ID NO: 1394975 - DNA, 22 bp, Artificial Sequence
  chemically synthesized
gctataagaaatacattgtccc

SEQ ID NO: 1394976 - DNA, 22 bp, Artificial Sequence
  chemically synthesized
tgctataagaaatacattgtcc

SEQ ID NO: 1394977 - DNA, 22 bp, Artificial Sequence
  chemically synthesized
tttgctataagaaatacattgt

SEQ ID NO: 1394978 - DNA, 22 bp, Artificial Sequence
  chemically synthesized
tggcttcagggacaatgtattt

SEQ ID NO: 1394979 - DNA, 22 bp, Artificial Sequence
  chemically synthesized
gtctctttgctataagaaatac

SEQ ID NO: 1394980 - DNA, 22 bp, Artificial Sequence
  chemically synthesized
cagggacaatgtatttcttata

SEQ ID NO: 1394981 - DNA, 22 bp, Artificial Sequence
  chemically synthesized
agggacaatgtatttcttatag

SEQ ID NO: 1394982 - DNA, 22 bp, Artificial Sequence
  chemically synthesized
attggtctctttgctataagaa

SEQ ID NO: 1394983 - DNA, 22 bp, Artificial Sequence
  chemically synthesized
ttaattggtctctttgctataa

SEQ ID NO: 1394984 - DNA, 22 bp, Artificial Sequence
  chemically synthesized
gttaattggtctctttgctata

SEQ ID NO: 1394985 - DNA, 22 bp, Artificial Sequence
  chemically synthesized
tcgaaccttgttaattggtctc

SEQ ID NO: 1394986 - DNA, 22 bp, Artificial Sequence
  chemically synthesized
cttatagcaaagagaccaatta

SEQ ID NO: 1394987 - DNA, 22 bp, Artificial Sequence
  chemically synthesized
atcgaaccttgttaattggtct

SEQ ID NO: 1394988 - DNA, 22 bp, Artificial Sequence
  chemically synthesized
ttatagcaaagagaccaattaa

SEQ ID NO: 1394989 - DNA, 22 bp, Artificial Sequence
  chemically synthesized
tatcgaaccttgttaattggtc

SEQ ID NO: 1394990 - DNA, 22 bp, Artificial Sequence
  chemically synthesized
atagcaaagagaccaattaaca

SEQ ID NO: 1394991 - DNA, 22 bp, Artificial Sequence
  chemically synthesized
tagcaaagagaccaattaacaa

SEQ ID NO: 1394992 - DNA, 22 bp, Artificial Sequence
  chemically synthesized
ctttatcgaaccttgttaattg

SEQ ID NO: 1394993 - DNA, 22 bp, Artificial Sequence
  chemically synthesized
acaaggttcgataaagcagtat

SEQ ID NO: 1394994 - DNA, 22 bp, Artificial Sequence
  chemically synthesized
aaggacagcgagtgcatggata

SEQ ID NO: 1394995 - DNA, 22 bp, Artificial Sequence
  chemically synthesized
gataaagcagtatccatgcact

SEQ ID NO: 1394996 - DNA, 22 bp, Artificial Sequence
  chemically synthesized
atgcaaaatactgaaggacagc

SEQ ID NO: 1394997 - DNA, 22 bp, Artificial Sequence
  chemically synthesized
catgcaaaatactgaaggacag

SEQ ID NO: 1394998 - DNA, 22 bp, Artificial Sequence
  chemically synthesized
gcttcatgcaaaatactgaagg

SEQ ID NO: 1394999 - DNA, 22 bp, Artificial Sequence
  chemically synthesized
ggcttcatgcaaaatactgaag

SEQ ID NO: 1395000 - DNA, 22 bp, Artificial Sequence
  chemically synthesized
tggcttcatgcaaaatactgaa

SEQ ID NO: 1395001 - DNA, 22 bp, Artificial Sequence
  chemically synthesized
cctttggcttcatgcaaaatac

SEQ ID NO: 1395002 - DNA, 22 bp, Artificial Sequence
  chemically synthesized
gctgtccttcagtattttgcat

SEQ ID NO: 1395003 - DNA, 22 bp, Artificial Sequence
  chemically synthesized
tgcctttggcttcatgcaaaat

SEQ ID NO: 1395004 - DNA, 22 bp, Artificial Sequence
  chemically synthesized
tccttcagtattttgcatgaag

SEQ ID NO: 1395005 - DNA, 22 bp, Artificial Sequence
  chemically synthesized
cagtattttgcatgaagccaaa

SEQ ID NO: 1395006 - DNA, 22 bp, Artificial Sequence
  chemically synthesized
gcatattctgcctttggcttca

SEQ ID NO: 1395007 - DNA, 22 bp, Artificial Sequence
  chemically synthesized
agtattttgcatgaagccaaag

SEQ ID NO: 1395008 - DNA, 22 bp, Artificial Sequence
  chemically synthesized
tagcatattctgcctttggctt

SEQ ID NO: 1395009 - DNA, 22 bp, Artificial Sequence
  chemically synthesized
ctagcatattctgcctttggct

SEQ ID NO: 1395010 - DNA, 22 bp, Artificial Sequence
  chemically synthesized
cttctagcatattctgcctttg

SEQ ID NO: 1395011 - DNA, 22 bp, Artificial Sequence
  chemically synthesized
tgcatgaagccaaaggcagaat

SEQ ID NO: 1395012 - DNA, 22 bp, Artificial Sequence
  chemically synthesized
tacttctagcatattctgcctt

SEQ ID NO: 1395013 - DNA, 22 bp, Artificial Sequence
  chemically synthesized
gcatgaagccaaaggcagaata

SEQ ID NO: 1395014 - DNA, 22 bp, Artificial Sequence
  chemically synthesized
ctacttctagcatattctgcct

SEQ ID NO: 1395015 - DNA, 22 bp, Artificial Sequence
  chemically synthesized
catgaagccaaaggcagaatat

SEQ ID NO: 1395016 - DNA, 22 bp, Artificial Sequence
  chemically synthesized
tctacttctagcatattctgcc

SEQ ID NO: 1395017 - DNA, 22 bp, Artificial Sequence
  chemically synthesized
ttctacttctagcatattctgc

SEQ ID NO: 1395018 - DNA, 22 bp, Artificial Sequence
  chemically synthesized
cttttctacttctagcatattc

SEQ ID NO: 1395019 - DNA, 22 bp, Artificial Sequence
  chemically synthesized
ctgcttttctacttctagcata

SEQ ID NO: 1395020 - DNA, 22 bp, Artificial Sequence
  chemically synthesized
acctcctgcttttctacttcta

SEQ ID NO: 1395021 - DNA, 22 bp, Artificial Sequence
  chemically synthesized
aacctcctgcttttctacttct

SEQ ID NO: 1395022 - DNA, 22 bp, Artificial Sequence
  chemically synthesized
taacctcctgcttttctacttc

SEQ ID NO: 1395023 - DNA, 22 bp, Artificial Sequence
  chemically synthesized
ttttaacctcctgcttttctac

SEQ ID NO: 1395024 - DNA, 22 bp, Artificial Sequence
  chemically synthesized
gaagtagaaaagcaggaggtta

SEQ ID NO: 1395025 - DNA, 22 bp, Artificial Sequence
  chemically synthesized
gtgataatggttattttaacct

SEQ ID NO: 1395026 - DNA, 22 bp, Artificial Sequence
  chemically synthesized
aaataaccattatcaccaggac

SEQ ID NO: 1395027 - DNA, 22 bp, Artificial Sequence
  chemically synthesized
agtggtgtcagggtcctggtga

SEQ ID NO: 1395028 - DNA, 22 bp, Artificial Sequence
  chemically synthesized
gagtggtgtcagggtcctggtg

SEQ ID NO: 1395029 - DNA, 22 bp, Artificial Sequence
  chemically synthesized
gccttgagtggtgtcagggtcc

SEQ ID NO: 1395030 - DNA, 22 bp, Artificial Sequence
  chemically synthesized
tcaccaggaccctgacaccact

SEQ ID NO: 1395031 - DNA, 22 bp, Artificial Sequence
  chemically synthesized
aatcagacaatgcctggccttg

SEQ ID NO: 1395032 - DNA, 22 bp, Artificial Sequence
  chemically synthesized
acaccactcaaggccaggcatt

SEQ ID NO: 1395033 - DNA, 22 bp, Artificial Sequence
  chemically synthesized
cctaaatcagacaatgcctggc

SEQ ID NO: 1395034 - DNA, 22 bp, Artificial Sequence
  chemically synthesized
tccctaaatcagacaatgcctg

SEQ ID NO: 1395035 - DNA, 22 bp, Artificial Sequence
  chemically synthesized
ctccctaaatcagacaatgcct

SEQ ID NO: 1395036 - DNA, 22 bp, Artificial Sequence
  chemically synthesized
aaggccaggcattgtctgattt

SEQ ID NO: 1395037 - DNA, 22 bp, Artificial Sequence
  chemically synthesized
atgcttctccctaaatcagaca

SEQ ID NO: 1395038 - DNA, 22 bp, Artificial Sequence
  chemically synthesized
gaaggaaactcatgcttctccc

SEQ ID NO: 1395039 - DNA, 22 bp, Artificial Sequence
  chemically synthesized
ggaaggaaactcatgcttctcc

SEQ ID NO: 1395040 - DNA, 22 bp, Artificial Sequence
  chemically synthesized
tctgatttagggagaagcatga

SEQ ID NO: 1395041 - DNA, 22 bp, Artificial Sequence
  chemically synthesized
atttagggagaagcatgagttt

SEQ ID NO: 1395042 - DNA, 22 bp, Artificial Sequence
  chemically synthesized
agggagaagcatgagtttcctt

SEQ ID NO: 1395043 - DNA, 22 bp, Artificial Sequence
  chemically synthesized
gggagaagcatgagtttccttc

SEQ ID NO: 1395044 - DNA, 22 bp, Artificial Sequence
  chemically synthesized
caggtaataccacttggaagga

SEQ ID NO: 1395045 - DNA, 22 bp, Artificial Sequence
  chemically synthesized
acaggtaataccacttggaagg

SEQ ID NO: 1395046 - DNA, 22 bp, Artificial Sequence
  chemically synthesized
tacaggtaataccacttggaag

SEQ ID NO: 1395047 - DNA, 22 bp, Artificial Sequence
  chemically synthesized
ttacaggtaataccacttggaa

SEQ ID NO: 1395048 - DNA, 22 bp, Artificial Sequence
  chemically synthesized
gtttttacaggtaataccactt

SEQ ID NO: 1395049 - DNA, 22 bp, Artificial Sequence
  chemically synthesized
ccctggtttttacaggtaatac

SEQ ID NO: 1395050 - DNA, 22 bp, Artificial Sequence
  chemically synthesized
ccttccaagtggtattacctgt

SEQ ID NO: 1395051 - DNA, 22 bp, Artificial Sequence
  chemically synthesized
cttccaagtggtattacctgta

SEQ ID NO: 1395052 - DNA, 22 bp, Artificial Sequence
  chemically synthesized
ccaagtggtattacctgtaaaa

SEQ ID NO: 1395053 - DNA, 22 bp, Artificial Sequence
  chemically synthesized
caagtggtattacctgtaaaaa

SEQ ID NO: 1395054 - DNA, 22 bp, Artificial Sequence
  chemically synthesized
gagagtgaattgccctggtttt

SEQ ID NO: 1395055 - DNA, 22 bp, Artificial Sequence
  chemically synthesized
cctggagagtgaattgccctgg

SEQ ID NO: 1395056 - DNA, 22 bp, Artificial Sequence
  chemically synthesized
acctggagagtgaattgccctg

SEQ ID NO: 1395057 - DNA, 22 bp, Artificial Sequence
  chemically synthesized
cctgtaaaaaccagggcaattc

SEQ ID NO: 1395058 - DNA, 22 bp, Artificial Sequence
  chemically synthesized
taaaaaccagggcaattcactc

SEQ ID NO: 1395059 - DNA, 22 bp, Artificial Sequence
  chemically synthesized
aggccttacctggagagtgaat

SEQ ID NO: 1395060 - DNA, 22 bp, Artificial Sequence
  chemically synthesized
ctaaggccttacctggagagtg

SEQ ID NO: 1395061 - DNA, 22 bp, Artificial Sequence
  chemically synthesized
actctccaggtaaggccttagg

SEQ ID NO: 1395062 - DNA, 22 bp, Artificial Sequence
  chemically synthesized
tccaggtaaggccttaggaact

SEQ ID NO: 1395063 - DNA, 22 bp, Artificial Sequence
  chemically synthesized
caggtaaggccttaggaactgt

SEQ ID NO: 1395064 - DNA, 22 bp, Artificial Sequence
  chemically synthesized
agatggaaaaatgtgtacgtac

SEQ ID NO: 1395065 - DNA, 22 bp, Artificial Sequence
  chemically synthesized
aggaactgtacgtacacatttt

SEQ ID NO: 1395066 - DNA, 22 bp, Artificial Sequence
  chemically synthesized
ggaactgtacgtacacattttt

SEQ ID NO: 1395067 - DNA, 22 bp, Artificial Sequence
  chemically synthesized
caaaattgagatggaaaaatgt

SEQ ID NO: 1395068 - DNA, 22 bp, Artificial Sequence
  chemically synthesized
gcaaaattgagatggaaaaatg

SEQ ID NO: 1395069 - DNA, 22 bp, Artificial Sequence
  chemically synthesized
tacgtacacatttttccatctc

SEQ ID NO: 1395070 - DNA, 22 bp, Artificial Sequence
  chemically synthesized
aagaggtgcttgcaaaattgag

SEQ ID NO: 1395071 - DNA, 22 bp, Artificial Sequence
  chemically synthesized
gaagaggtgcttgcaaaattga

SEQ ID NO: 1395072 - DNA, 22 bp, Artificial Sequence
  chemically synthesized
tgaagaggtgcttgcaaaattg

SEQ ID NO: 1395073 - DNA, 22 bp, Artificial Sequence
  chemically synthesized
ttttgaagaggtgcttgcaaaa

SEQ ID NO: 1395074 - DNA, 22 bp, Artificial Sequence
  chemically synthesized
ttccatctcaattttgcaagca

SEQ ID NO: 1395075 - DNA, 22 bp, Artificial Sequence
  chemically synthesized
tccatctcaattttgcaagcac

SEQ ID NO: 1395076 - DNA, 22 bp, Artificial Sequence
  chemically synthesized
ccatctcaattttgcaagcacc

SEQ ID NO: 1395077 - DNA, 22 bp, Artificial Sequence
  chemically synthesized
catctcaattttgcaagcacct

SEQ ID NO: 1395078 - DNA, 22 bp, Artificial Sequence
  chemically synthesized
aattttgcaagcacctcttcaa

SEQ ID NO: 1395079 - DNA, 22 bp, Artificial Sequence
  chemically synthesized
tgcaagcacctcttcaaaatag

SEQ ID NO: 1395080 - DNA, 22 bp, Artificial Sequence
  chemically synthesized
gcaagcacctcttcaaaatagt

SEQ ID NO: 1395081 - DNA, 22 bp, Artificial Sequence
  chemically synthesized
caagcacctcttcaaaatagtg

SEQ ID NO: 1395082 - DNA, 22 bp, Artificial Sequence
  chemically synthesized
gagtgggcagggtatccacaca

SEQ ID NO: 1395083 - DNA, 22 bp, Artificial Sequence
  chemically synthesized
ggagtgggcagggtatccacac

SEQ ID NO: 1395084 - DNA, 22 bp, Artificial Sequence
  chemically synthesized
ttcaaaatagtgtgtggatacc

SEQ ID NO: 1395085 - DNA, 22 bp, Artificial Sequence
  chemically synthesized
caaaatagtgtgtggataccct

SEQ ID NO: 1395086 - DNA, 22 bp, Artificial Sequence
  chemically synthesized
tttggagtgggcagggtatcca

SEQ ID NO: 1395087 - DNA, 22 bp, Artificial Sequence
  chemically synthesized
aaaatagtgtgtggataccctg

SEQ ID NO: 1395088 - DNA, 22 bp, Artificial Sequence
  chemically synthesized
tctgtttggagtgggcagggta

SEQ ID NO: 1395089 - DNA, 22 bp, Artificial Sequence
  chemically synthesized
tgtctgtttggagtgggcaggg

SEQ ID NO: 1395090 - DNA, 22 bp, Artificial Sequence
  chemically synthesized
ctgtctgtttggagtgggcagg

SEQ ID NO: 1395091 - DNA, 22 bp, Artificial Sequence
  chemically synthesized
tttctgtctgtttggagtgggc

SEQ ID NO: 1395092 - DNA, 22 bp, Artificial Sequence
  chemically synthesized
cccactccaaacagacagaaat

SEQ ID NO: 1395093 - DNA, 22 bp, Artificial Sequence
  chemically synthesized
tgtagagagccacctatttctg

SEQ ID NO: 1395094 - DNA, 22 bp, Artificial Sequence
  chemically synthesized
caaacagacagaaataggtggc

SEQ ID NO: 1395095 - DNA, 22 bp, Artificial Sequence
  chemically synthesized
agcattatgtagagagccacct

SEQ ID NO: 1395096 - DNA, 22 bp, Artificial Sequence
  chemically synthesized
taagcattatgtagagagccac

SEQ ID NO: 1395097 - DNA, 22 bp, Artificial Sequence
  chemically synthesized
ctaagcattatgtagagagcca

SEQ ID NO: 1395098 - DNA, 22 bp, Artificial Sequence
  chemically synthesized
tctacataatgcttagaaatta

SEQ ID NO: 1395099 - DNA, 22 bp, Artificial Sequence
  chemically synthesized
tacataatgcttagaaattata

SEQ ID NO: 1395100 - DNA, 22 bp, Artificial Sequence
  chemically synthesized
cataatgcttagaaattatact

SEQ ID NO: 1395101 - DNA, 22 bp, Artificial Sequence
  chemically synthesized
aaaaaaaatataccatgaagta

SEQ ID NO: 1395102 - DNA, 22 bp, Artificial Sequence
  chemically synthesized
aaaaaaaaatataccatgaagt

SEQ ID NO: 1395103 - DNA, 22 bp, Artificial Sequence
  chemically synthesized
agaaattatacttcatggtata

SEQ ID NO: 1395104 - DNA, 22 bp, Artificial Sequence
  chemically synthesized
cttaaaaaaaaatataccatga

SEQ ID NO: 1395105 - DNA, 22 bp, Artificial Sequence
  chemically synthesized
gaaattatacttcatggtatat

SEQ ID NO: 1395106 - DNA, 22 bp, Artificial Sequence
  chemically synthesized
ccttaaaaaaaaatataccatg

SEQ ID NO: 1395107 - DNA, 22 bp, Artificial Sequence
  chemically synthesized
tacttcatggtatatttttttt

SEQ ID NO: 1395108 - DNA, 22 bp, Artificial Sequence
  chemically synthesized
gcatgtcttccttaaaaaaaaa

SEQ ID NO: 1395109 - DNA, 22 bp, Artificial Sequence
  chemically synthesized
ggcatgtcttccttaaaaaaaa

SEQ ID NO: 1395110 - DNA, 22 bp, Artificial Sequence
  chemically synthesized
catggtatatttttttttaagg

SEQ ID NO: 1395111 - DNA, 22 bp, Artificial Sequence
  chemically synthesized
atggtatatttttttttaagga

SEQ ID NO: 1395112 - DNA, 22 bp, Artificial Sequence
  chemically synthesized
tgcttggcatgtcttccttaaa

SEQ ID NO: 1395113 - DNA, 22 bp, Artificial Sequence
  chemically synthesized
ttttttaaggaagacatgccaa

SEQ ID NO: 1395114 - DNA, 22 bp, Artificial Sequence
  chemically synthesized
tttttaaggaagacatgccaag

SEQ ID NO: 1395115 - DNA, 22 bp, Artificial Sequence
  chemically synthesized
ttttaaggaagacatgccaagc

SEQ ID NO: 1395116 - DNA, 22 bp, Artificial Sequence
  chemically synthesized
tttaaggaagacatgccaagca

SEQ ID NO: 1395117 - DNA, 22 bp, Artificial Sequence
  chemically synthesized
ttaaggaagacatgccaagcat

SEQ ID NO: 1395118 - DNA, 22 bp, Artificial Sequence
  chemically synthesized
taaggaagacatgccaagcata

SEQ ID NO: 1395119 - DNA, 22 bp, Artificial Sequence
  chemically synthesized
aaggaagacatgccaagcataa

SEQ ID NO: 1395120 - DNA, 22 bp, Artificial Sequence
  chemically synthesized
aggaagacatgccaagcataat

SEQ ID NO: 1395121 - DNA, 22 bp, Artificial Sequence
  chemically synthesized
acaagggcataagatcattatg

SEQ ID NO: 1395122 - DNA, 22 bp, Artificial Sequence
  chemically synthesized
cacaagggcataagatcattat

SEQ ID NO: 1395123 - DNA, 22 bp, Artificial Sequence
  chemically synthesized
aaaagtttcacaagggcataag

SEQ ID NO: 1395124 - DNA, 22 bp, Artificial Sequence
  chemically synthesized
aaaaagtttcacaagggcataa

SEQ ID NO: 1395125 - DNA, 22 bp, Artificial Sequence
  chemically synthesized
taaaaagtttcacaagggcata

SEQ ID NO: 1395126 - DNA, 22 bp, Artificial Sequence
  chemically synthesized
acaattttaaaaagtttcacaa

SEQ ID NO: 1395127 - DNA, 22 bp, Artificial Sequence
  chemically synthesized
tgttcacaattttaaaaagttt

SEQ ID NO: 1395128 - DNA, 22 bp, Artificial Sequence
  chemically synthesized
atgcccttgtgaaactttttaa

SEQ ID NO: 1395129 - DNA, 22 bp, Artificial Sequence
  chemically synthesized
tgcccttgtgaaactttttaaa

SEQ ID NO: 1395130 - DNA, 22 bp, Artificial Sequence
  chemically synthesized
gtgaaactttttaaaattgtga

SEQ ID NO: 1395131 - DNA, 22 bp, Artificial Sequence
  chemically synthesized
tgaaactttttaaaattgtgaa

SEQ ID NO: 1395132 - DNA, 22 bp, Artificial Sequence
  chemically synthesized
gaatgagatacactgtgttcac

SEQ ID NO: 1395133 - DNA, 22 bp, Artificial Sequence
  chemically synthesized
tttaaaattgtgaacacagtgt

SEQ ID NO: 1395134 - DNA, 22 bp, Artificial Sequence
  chemically synthesized
ttaaaattgtgaacacagtgta

SEQ ID NO: 1395135 - DNA, 22 bp, Artificial Sequence
  chemically synthesized
taaaattgtgaacacagtgtat

SEQ ID NO: 1395136 - DNA, 22 bp, Artificial Sequence
  chemically synthesized
aaaattgtgaacacagtgtatc

SEQ ID NO: 1395137 - DNA, 22 bp, Artificial Sequence
  chemically synthesized
aaattgtgaacacagtgtatct

SEQ ID NO: 1395138 - DNA, 22 bp, Artificial Sequence
  chemically synthesized
tgaacacagtgtatctcattcc

SEQ ID NO: 1395139 - DNA, 22 bp, Artificial Sequence
  chemically synthesized
taaaatcgaattggaatgagat

SEQ ID NO: 1395140 - DNA, 22 bp, Artificial Sequence
  chemically synthesized
gtaaaatcgaattggaatgaga

SEQ ID NO: 1395141 - DNA, 22 bp, Artificial Sequence
  chemically synthesized
tgtaaaatcgaattggaatgag

SEQ ID NO: 1395142 - DNA, 22 bp, Artificial Sequence
  chemically synthesized
cataattttgtaaaatcgaatt

SEQ ID NO: 1395143 - DNA, 22 bp, Artificial Sequence
  chemically synthesized
ctgcataattttgtaaaatcga

SEQ ID NO: 1395144 - DNA, 22 bp, Artificial Sequence
  chemically synthesized
actgcataattttgtaaaatcg

SEQ ID NO: 1395145 - DNA, 22 bp, Artificial Sequence
  chemically synthesized
attccaattcgattttacaaaa

SEQ ID NO: 1395146 - DNA, 22 bp, Artificial Sequence
  chemically synthesized
caattcgattttacaaaattat

SEQ ID NO: 1395147 - DNA, 22 bp, Artificial Sequence
  chemically synthesized
gattttacaaaattatgcagta

SEQ ID NO: 1395148 - DNA, 22 bp, Artificial Sequence
  chemically synthesized
tacaaaattatgcagtaagttt

SEQ ID NO: 1395149 - DNA, 22 bp, Artificial Sequence
  chemically synthesized
acaaaattatgcagtaagtttt

SEQ ID NO: 1395150 - DNA, 22 bp, Artificial Sequence
  chemically synthesized
caacaaagggaaaaaacttact

SEQ ID NO: 1395151 - DNA, 22 bp, Artificial Sequence
  chemically synthesized
caaaattatgcagtaagttttt

SEQ ID NO: 1395152 - DNA, 22 bp, Artificial Sequence
  chemically synthesized
acaacaaagggaaaaaacttac

SEQ ID NO: 1395153 - DNA, 22 bp, Artificial Sequence
  chemically synthesized
ttacaacaaagggaaaaaactt

SEQ ID NO: 1395154 - DNA, 22 bp, Artificial Sequence
  chemically synthesized
cttacaacaaagggaaaaaact

SEQ ID NO: 1395155 - DNA, 22 bp, Artificial Sequence
  chemically synthesized
tcttacaacaaagggaaaaaac

SEQ ID NO: 1395156 - DNA, 22 bp, Artificial Sequence
  chemically synthesized
tgcagtaagttttttccctttg

SEQ ID NO: 1395157 - DNA, 22 bp, Artificial Sequence
  chemically synthesized
agacacaaatattttcttacaa

SEQ ID NO: 1395158 - DNA, 22 bp, Artificial Sequence
  chemically synthesized
tttccctttgttgtaagaaaat

SEQ ID NO: 1395159 - DNA, 22 bp, Artificial Sequence
  chemically synthesized
ttccctttgttgtaagaaaata

SEQ ID NO: 1395160 - DNA, 22 bp, Artificial Sequence
  chemically synthesized
tccctttgttgtaagaaaatat

SEQ ID NO: 1395161 - DNA, 22 bp, Artificial Sequence
  chemically synthesized
ccctttgttgtaagaaaatatt

SEQ ID NO: 1395162 - DNA, 22 bp, Artificial Sequence
  chemically synthesized
cctttgttgtaagaaaatattt

SEQ ID NO: 1395163 - DNA, 22 bp, Artificial Sequence
  chemically synthesized
tgttgtaagaaaatatttgtgt

SEQ ID NO: 1395164 - DNA, 22 bp, Artificial Sequence
  chemically synthesized
gttgtaagaaaatatttgtgtc

SEQ ID NO: 1395165 - DNA, 22 bp, Artificial Sequence
  chemically synthesized
ttgtaagaaaatatttgtgtct

SEQ ID NO: 1395166 - DNA, 22 bp, Artificial Sequence
  chemically synthesized
taagaaaatatttgtgtcttag

SEQ ID NO: 1395167 - DNA, 22 bp, Artificial Sequence
  chemically synthesized
taatggcgccagtggactaaga

SEQ ID NO: 1395168 - DNA, 22 bp, Artificial Sequence
  chemically synthesized
ttataatggcgccagtggacta

SEQ ID NO: 1395169 - DNA, 22 bp, Artificial Sequence
  chemically synthesized
gttataatggcgccagtggact

SEQ ID NO: 1395170 - DNA, 22 bp, Artificial Sequence
  chemically synthesized
tgttataatggcgccagtggac

SEQ ID NO: 1395171 - DNA, 22 bp, Artificial Sequence
  chemically synthesized
gtgtcttagtccactggcgcca

SEQ ID NO: 1395172 - DNA, 22 bp, Artificial Sequence
  chemically synthesized
tgtcttagtccactggcgccat

SEQ ID NO: 1395173 - DNA, 22 bp, Artificial Sequence
  chemically synthesized
agatattttgttataatggcgc

SEQ ID NO: 1395174 - DNA, 22 bp, Artificial Sequence
  chemically synthesized
agtccactggcgccattataac

SEQ ID NO: 1395175 - DNA, 22 bp, Artificial Sequence
  chemically synthesized
gtccactggcgccattataaca

SEQ ID NO: 1395176 - DNA, 22 bp, Artificial Sequence
  chemically synthesized
tctcagatattttgttataatg

SEQ ID NO: 1395177 - DNA, 22 bp, Artificial Sequence
  chemically synthesized
cctgtctcagatattttgttat

SEQ ID NO: 1395178 - DNA, 22 bp, Artificial Sequence
  chemically synthesized
gcgccattataacaaaatatct

SEQ ID NO: 1395179 - DNA, 22 bp, Artificial Sequence
  chemically synthesized
taaattacctgtctcagatatt

SEQ ID NO: 1395180 - DNA, 22 bp, Artificial Sequence
  chemically synthesized
ataaattacctgtctcagatat

SEQ ID NO: 1395181 - DNA, 22 bp, Artificial Sequence
  chemically synthesized
tttataaattacctgtctcaga

SEQ ID NO: 1395182 - DNA, 22 bp, Artificial Sequence
  chemically synthesized
taacaaaatatctgagacaggt

SEQ ID NO: 1395183 - DNA, 22 bp, Artificial Sequence
  chemically synthesized
ttgtttataaattacctgtctc

SEQ ID NO: 1395184 - DNA, 22 bp, Artificial Sequence
  chemically synthesized
tgttgtttataaattacctgtc

SEQ ID NO: 1395185 - DNA, 22 bp, Artificial Sequence
  chemically synthesized
ctgttgtttataaattacctgt

SEQ ID NO: 1395186 - DNA, 22 bp, Artificial Sequence
  chemically synthesized
atttctgttgtttataaattac

SEQ ID NO: 1395187 - DNA, 22 bp, Artificial Sequence
  chemically synthesized
agacaggtaatttataaacaac

SEQ ID NO: 1395188 - DNA, 22 bp, Artificial Sequence
  chemically synthesized
cgaacaattaatttctgttgtt

SEQ ID NO: 1395189 - DNA, 22 bp, Artificial Sequence
  chemically synthesized
cagaactgcgaacaattaattt

SEQ ID NO: 1395190 - DNA, 22 bp, Artificial Sequence
  chemically synthesized
ataaacaacagaaattaattgt

SEQ ID NO: 1395191 - DNA, 22 bp, Artificial Sequence
  chemically synthesized
taaacaacagaaattaattgtt

SEQ ID NO: 1395192 - DNA, 22 bp, Artificial Sequence
  chemically synthesized
accagcctacagaactgcgaac

SEQ ID NO: 1395193 - DNA, 22 bp, Artificial Sequence
  chemically synthesized
attgttcgcagttctgtaggct

SEQ ID NO: 1395194 - DNA, 22 bp, Artificial Sequence
  chemically synthesized
accagacacctcaccagcctac

SEQ ID NO: 1395195 - DNA, 22 bp, Artificial Sequence
  chemically synthesized
ttcgcagttctgtaggctggtg

SEQ ID NO: 1395196 - DNA, 22 bp, Artificial Sequence
  chemically synthesized
gcagttctgtaggctggtgagg

SEQ ID NO: 1395197 - DNA, 22 bp, Artificial Sequence
  chemically synthesized
ggtcctcaccagacacctcacc

SEQ ID NO: 1395198 - DNA, 22 bp, Artificial Sequence
  chemically synthesized
tgtaggctggtgaggtgtctgg

SEQ ID NO: 1395199 - DNA, 22 bp, Artificial Sequence
  chemically synthesized
taggctggtgaggtgtctggtg

SEQ ID NO: 1395200 - DNA, 22 bp, Artificial Sequence
  chemically synthesized
gtgaggtgtctggtgaggaccc

SEQ ID NO: 1395201 - DNA, 22 bp, Artificial Sequence
  chemically synthesized
gaagcagagactgggtcctcac

SEQ ID NO: 1395202 - DNA, 22 bp, Artificial Sequence
  chemically synthesized
cgaagcagagactgggtcctca

SEQ ID NO: 1395203 - DNA, 22 bp, Artificial Sequence
  chemically synthesized
gtgaggacccagtctctgcttc

SEQ ID NO: 1395204 - DNA, 22 bp, Artificial Sequence
  chemically synthesized
aaggcatcatcttcgaagcaga

SEQ ID NO: 1395205 - DNA, 22 bp, Artificial Sequence
  chemically synthesized
tgcttcgaagatgatgccttga

SEQ ID NO: 1395206 - DNA, 22 bp, Artificial Sequence
  chemically synthesized
gaggatgcaacgttcaaggcat

SEQ ID NO: 1395207 - DNA, 22 bp, Artificial Sequence
  chemically synthesized
cttcgaagatgatgccttgaac

SEQ ID NO: 1395208 - DNA, 22 bp, Artificial Sequence
  chemically synthesized
tggaggatgcaacgttcaaggc

SEQ ID NO: 1395209 - DNA, 22 bp, Artificial Sequence
  chemically synthesized
cgaagatgatgccttgaacgtt

SEQ ID NO: 1395210 - DNA, 22 bp, Artificial Sequence
  chemically synthesized
tctggaggatgcaacgttcaag

SEQ ID NO: 1395211 - DNA, 22 bp, Artificial Sequence
  chemically synthesized
gaagatgatgccttgaacgttg

SEQ ID NO: 1395212 - DNA, 22 bp, Artificial Sequence
  chemically synthesized
tctctggaggatgcaacgttca

SEQ ID NO: 1395213 - DNA, 22 bp, Artificial Sequence
  chemically synthesized
ctctctggaggatgcaacgttc

SEQ ID NO: 1395214 - DNA, 22 bp, Artificial Sequence
  chemically synthesized
gaacgttgcatcctccagagag

SEQ ID NO: 1395215 - DNA, 22 bp, Artificial Sequence
  chemically synthesized
aacgttgcatcctccagagaga

SEQ ID NO: 1395216 - DNA, 22 bp, Artificial Sequence
  chemically synthesized
catcctccagagagaagggatg

SEQ ID NO: 1395217 - DNA, 22 bp, Artificial Sequence
  chemically synthesized
tgggaggacacagcatcccttc

SEQ ID NO: 1395218 - DNA, 22 bp, Artificial Sequence
  chemically synthesized
cactatgggaggacacagcatc

SEQ ID NO: 1395219 - DNA, 22 bp, Artificial Sequence
  chemically synthesized
cagagagaagggatgctgtgtc

SEQ ID NO: 1395220 - DNA, 22 bp, Artificial Sequence
  chemically synthesized
ccactatgggaggacacagcat

SEQ ID NO: 1395221 - DNA, 22 bp, Artificial Sequence
  chemically synthesized
catcacttccactatgggagga

SEQ ID NO: 1395222 - DNA, 22 bp, Artificial Sequence
  chemically synthesized
ccatcacttccactatgggagg

SEQ ID NO: 1395223 - DNA, 22 bp, Artificial Sequence
  chemically synthesized
tccatcacttccactatgggag

SEQ ID NO: 1395224 - DNA, 22 bp, Artificial Sequence
  chemically synthesized
ttccatcacttccactatggga

SEQ ID NO: 1395225 - DNA, 22 bp, Artificial Sequence
  chemically synthesized
tatttttccatcacttccacta

SEQ ID NO: 1395226 - DNA, 22 bp, Artificial Sequence
  chemically synthesized
atatttttccatcacttccact

SEQ ID NO: 1395227 - DNA, 22 bp, Artificial Sequence
  chemically synthesized
tgtcctcccatagtggaagtga

SEQ ID NO: 1395228 - DNA, 22 bp, Artificial Sequence
  chemically synthesized
ttatatttttccatcacttcca

SEQ ID NO: 1395229 - DNA, 22 bp, Artificial Sequence
  chemically synthesized
ggctcttatatttttccatcac

SEQ ID NO: 1395230 - DNA, 22 bp, Artificial Sequence
  chemically synthesized
ccatagtggaagtgatggaaaa

SEQ ID NO: 1395231 - DNA, 22 bp, Artificial Sequence
  chemically synthesized
actaggctcttatatttttcca

SEQ ID NO: 1395232 - DNA, 22 bp, Artificial Sequence
  chemically synthesized
gtgagaaccgagaactaactag

SEQ ID NO: 1395233 - DNA, 22 bp, Artificial Sequence
  chemically synthesized
taaaaaggctggtgagaaccga

SEQ ID NO: 1395234 - DNA, 22 bp, Artificial Sequence
  chemically synthesized
ataaaaaggctggtgagaaccg

SEQ ID NO: 1395235 - DNA, 22 bp, Artificial Sequence
  chemically synthesized
gttagttctcggttctcaccag

SEQ ID NO: 1395236 - DNA, 22 bp, Artificial Sequence
  chemically synthesized
gttctcggttctcaccagcctt

SEQ ID NO: 1395237 - DNA, 22 bp, Artificial Sequence
  chemically synthesized
atgaccttataaaaaggctggt

SEQ ID NO: 1395238 - DNA, 22 bp, Artificial Sequence
  chemically synthesized
tcggttctcaccagccttttta

SEQ ID NO: 1395239 - DNA, 22 bp, Artificial Sequence
  chemically synthesized
ggttctcaccagcctttttata

SEQ ID NO: 1395240 - DNA, 22 bp, Artificial Sequence
  chemically synthesized
tcaccagcctttttataaggtc

SEQ ID NO: 1395241 - DNA, 22 bp, Artificial Sequence
  chemically synthesized
accagcctttttataaggtcat

SEQ ID NO: 1395242 - DNA, 22 bp, Artificial Sequence
  chemically synthesized
atgaatgggattaatgacctta

SEQ ID NO: 1395243 - DNA, 22 bp, Artificial Sequence
  chemically synthesized
tttataaggtcattaatcccat

SEQ ID NO: 1395244 - DNA, 22 bp, Artificial Sequence
  chemically synthesized
ttataaggtcattaatcccatt

SEQ ID NO: 1395245 - DNA, 22 bp, Artificial Sequence
  chemically synthesized
tataaggtcattaatcccattc

SEQ ID NO: 1395246 - DNA, 22 bp, Artificial Sequence
  chemically synthesized
ataaggtcattaatcccattca

SEQ ID NO: 1395247 - DNA, 22 bp, Artificial Sequence
  chemically synthesized
taaggtcattaatcccattcat

SEQ ID NO: 1395248 - DNA, 22 bp, Artificial Sequence
  chemically synthesized
aatcatgagggcagagccctaa

SEQ ID NO: 1395249 - DNA, 22 bp, Artificial Sequence
  chemically synthesized
atcccattcattagggctctgc

SEQ ID NO: 1395250 - DNA, 22 bp, Artificial Sequence
  chemically synthesized
attagggctctgccctcatgat

SEQ ID NO: 1395251 - DNA, 22 bp, Artificial Sequence
  chemically synthesized
ggaggtgattaaatcatgaggg

SEQ ID NO: 1395252 - DNA, 22 bp, Artificial Sequence
  chemically synthesized
gggctctgccctcatgatttaa

SEQ ID NO: 1395253 - DNA, 22 bp, Artificial Sequence
  chemically synthesized
tgccctcatgatttaatcacct

SEQ ID NO: 1395254 - DNA, 22 bp, Artificial Sequence
  chemically synthesized
ccctcatgatttaatcacctcc

SEQ ID NO: 1395255 - DNA, 22 bp, Artificial Sequence
  chemically synthesized
atgatttaatcacctcctaatg

SEQ ID NO: 1395256 - DNA, 22 bp, Artificial Sequence
  chemically synthesized
aaaggtggaggacattaggagg

SEQ ID NO: 1395257 - DNA, 22 bp, Artificial Sequence
  chemically synthesized
aatcacctcctaatgtcctcca

SEQ ID NO: 1395258 - DNA, 22 bp, Artificial Sequence
  chemically synthesized
atcacctcctaatgtcctccac

SEQ ID NO: 1395259 - DNA, 22 bp, Artificial Sequence
  chemically synthesized
ctaatgtcctccaccttttagt

SEQ ID NO: 1395260 - DNA, 22 bp, Artificial Sequence
  chemically synthesized
ccaatatgatagtactaaaagg

SEQ ID NO: 1395261 - DNA, 22 bp, Artificial Sequence
  chemically synthesized
atgtcctccaccttttagtact

SEQ ID NO: 1395262 - DNA, 22 bp, Artificial Sequence
  chemically synthesized
attgccaatatgatagtactaa

SEQ ID NO: 1395263 - DNA, 22 bp, Artificial Sequence
  chemically synthesized
aattgccaatatgatagtacta

SEQ ID NO: 1395264 - DNA, 22 bp, Artificial Sequence
  chemically synthesized
caccttttagtactatcatatt

SEQ ID NO: 1395265 - DNA, 22 bp, Artificial Sequence
  chemically synthesized
aaacttaattgccaatatgata

SEQ ID NO: 1395266 - DNA, 22 bp, Artificial Sequence
  chemically synthesized
ttagtactatcatattggcaat

SEQ ID NO: 1395267 - DNA, 22 bp, Artificial Sequence
  chemically synthesized
tagtactatcatattggcaatt

SEQ ID NO: 1395268 - DNA, 22 bp, Artificial Sequence
  chemically synthesized
agtactatcatattggcaatta

SEQ ID NO: 1395269 - DNA, 22 bp, Artificial Sequence
  chemically synthesized
gtactatcatattggcaattaa

SEQ ID NO: 1395270 - DNA, 22 bp, Artificial Sequence
  chemically synthesized
atatgttgaaacttaattgcca

SEQ ID NO: 1395271 - DNA, 22 bp, Artificial Sequence
  chemically synthesized
tcatattggcaattaagtttca

SEQ ID NO: 1395272 - DNA, 22 bp, Artificial Sequence
  chemically synthesized
cataattcatatgttgaaactt

SEQ ID NO: 1395273 - DNA, 22 bp, Artificial Sequence
  chemically synthesized
gcaattaagtttcaacatatga

SEQ ID NO: 1395274 - DNA, 22 bp, Artificial Sequence
  chemically synthesized
aatgtgtcctacataattcata

SEQ ID NO: 1395275 - DNA, 22 bp, Artificial Sequence
  chemically synthesized
agtttcaacatatgaattatgt

SEQ ID NO: 1395276 - DNA, 22 bp, Artificial Sequence
  chemically synthesized
caacatatgaattatgtaggac

SEQ ID NO: 1395277 - DNA, 22 bp, Artificial Sequence
  chemically synthesized
tgatctgaatgtgtcctacata

SEQ ID NO: 1395278 - DNA, 22 bp, Artificial Sequence
  chemically synthesized
aacatatgaattatgtaggaca

SEQ ID NO: 1395279 - DNA, 22 bp, Artificial Sequence
  chemically synthesized
ctatgatctgaatgtgtcctac

SEQ ID NO: 1395280 - DNA, 22 bp, Artificial Sequence
  chemically synthesized
caaactgctatgatctgaatgt

SEQ ID NO: 1395281 - DNA, 22 bp, Artificial Sequence
  chemically synthesized
acaaactgctatgatctgaatg

SEQ ID NO: 1395282 - DNA, 22 bp, Artificial Sequence
  chemically synthesized
tgtaggacacattcagatcata

SEQ ID NO: 1395283 - DNA, 22 bp, Artificial Sequence
  chemically synthesized
tcttacaaactgctatgatctg

SEQ ID NO: 1395284 - DNA, 22 bp, Artificial Sequence
  chemically synthesized
atcttacaaactgctatgatct

SEQ ID NO: 1395285 - DNA, 22 bp, Artificial Sequence
  chemically synthesized
tatcttacaaactgctatgatc

SEQ ID NO: 1395286 - DNA, 22 bp, Artificial Sequence
  chemically synthesized
agatcatagcagtttgtaagat

SEQ ID NO: 1395287 - DNA, 22 bp, Artificial Sequence
  chemically synthesized
gtaagataaaatacatacatga

SEQ ID NO: 1395288 - DNA, 22 bp, Artificial Sequence
  chemically synthesized
taagataaaatacatacatgac

SEQ ID NO: 1395289 - DNA, 22 bp, Artificial Sequence
  chemically synthesized
catgatgaaatgtgtcatgtat

SEQ ID NO: 1395290 - DNA, 22 bp, Artificial Sequence
  chemically synthesized
acatgatgaaatgtgtcatgta

SEQ ID NO: 1395291 - DNA, 22 bp, Artificial Sequence
  chemically synthesized
atatcttacatgatgaaatgtg

SEQ ID NO: 1395292 - DNA, 22 bp, Artificial Sequence
  chemically synthesized
aatatcttacatgatgaaatgt

SEQ ID NO: 1395293 - DNA, 22 bp, Artificial Sequence
  chemically synthesized
aaacttaatatcttacatgatg

SEQ ID NO: 1395294 - DNA, 22 bp, Artificial Sequence
  chemically synthesized
aaaatattaaaacttaatatct

SEQ ID NO: 1395295 - DNA, 22 bp, Artificial Sequence
  chemically synthesized
caaaatattaaaacttaatatc

SEQ ID NO: 1395296 - DNA, 22 bp, Artificial Sequence
  chemically synthesized
tcaaaatattaaaacttaatat

SEQ ID NO: 1395297 - DNA, 22 bp, Artificial Sequence
  chemically synthesized
catcatgtaagatattaagttt

SEQ ID NO: 1395298 - DNA, 22 bp, Artificial Sequence
  chemically synthesized
ttcaaaatattaaaacttaata

SEQ ID NO: 1395299 - DNA, 22 bp, Artificial Sequence
  chemically synthesized
atcatgtaagatattaagtttt

SEQ ID NO: 1395300 - DNA, 22 bp, Artificial Sequence
  chemically synthesized
aaataaaatttttcaaaatatt

SEQ ID NO: 1395301 - DNA, 22 bp, Artificial Sequence
  chemically synthesized
agttttaatattttgaaaaatt

SEQ ID NO: 1395302 - DNA, 22 bp, Artificial Sequence
  chemically synthesized
taatattttgaaaaattttatt

SEQ ID NO: 1395303 - DNA, 22 bp, Artificial Sequence
  chemically synthesized
aatattttgaaaaattttattt

SEQ ID NO: 1395304 - DNA, 22 bp, Artificial Sequence
  chemically synthesized
atattttgaaaaattttatttt

SEQ ID NO: 1395305 - DNA, 22 bp, Artificial Sequence
  chemically synthesized
tgaaaaattttattttaatatt

SEQ ID NO: 1395306 - DNA, 22 bp, Artificial Sequence
  chemically synthesized
gaaaaattttattttaatattc

SEQ ID NO: 1395307 - DNA, 22 bp, Artificial Sequence
  chemically synthesized
aaaaattttattttaatattca

SEQ ID NO: 1395308 - DNA, 22 bp, Artificial Sequence
  chemically synthesized
tattttaatattcatttttcta

SEQ ID NO: 1395309 - DNA, 22 bp, Artificial Sequence
  chemically synthesized
attttaatattcatttttctac

SEQ ID NO: 1395310 - DNA, 22 bp, Artificial Sequence
  chemically synthesized
tgaaatatgtgtgtagaaaaat

SEQ ID NO: 1395311 - DNA, 22 bp, Artificial Sequence
  chemically synthesized
ttttaatattcatttttctaca

SEQ ID NO: 1395312 - DNA, 22 bp, Artificial Sequence
  chemically synthesized
taatattcatttttctacacac

SEQ ID NO: 1395313 - DNA, 22 bp, Artificial Sequence
  chemically synthesized
aatattcatttttctacacaca

SEQ ID NO: 1395314 - DNA, 22 bp, Artificial Sequence
  chemically synthesized
atattcatttttctacacacat

SEQ ID NO: 1395315 - DNA, 22 bp, Artificial Sequence
  chemically synthesized
atactatgaaatatgtgtgtag

SEQ ID NO: 1395316 - DNA, 22 bp, Artificial Sequence
  chemically synthesized
aatactatgaaatatgtgtgta

SEQ ID NO: 1395317 - DNA, 22 bp, Artificial Sequence
  chemically synthesized
atttttctacacacatatttca

SEQ ID NO: 1395318 - DNA, 22 bp, Artificial Sequence
  chemically synthesized
ttctacacacatatttcatagt

SEQ ID NO: 1395319 - DNA, 22 bp, Artificial Sequence
  chemically synthesized
tctacacacatatttcatagta

SEQ ID NO: 1395320 - DNA, 22 bp, Artificial Sequence
  chemically synthesized
ctacacacatatttcatagtat

SEQ ID NO: 1395321 - DNA, 22 bp, Artificial Sequence
  chemically synthesized
tacacacatatttcatagtatt

SEQ ID NO: 1395322 - DNA, 22 bp, Artificial Sequence
  chemically synthesized
cacacatatttcatagtattaa

SEQ ID NO: 1395323 - DNA, 22 bp, Artificial Sequence
  chemically synthesized
taaaaatatatagccaatatgt

SEQ ID NO: 1395324 - DNA, 22 bp, Artificial Sequence
  chemically synthesized
catagtattaaacatattggct

SEQ ID NO: 1395325 - DNA, 22 bp, Artificial Sequence
  chemically synthesized
atagtattaaacatattggcta

SEQ ID NO: 1395326 - DNA, 22 bp, Artificial Sequence
  chemically synthesized
atcacattataaaaatatatag

SEQ ID NO: 1395327 - DNA, 22 bp, Artificial Sequence
  chemically synthesized
aacatattggctatatattttt

SEQ ID NO: 1395328 - DNA, 22 bp, Artificial Sequence
  chemically synthesized
gctatatatttttataatgtga

SEQ ID NO: 1395329 - DNA, 22 bp, Artificial Sequence
  chemically synthesized
tatatttttataatgtgatcaa

SEQ ID NO: 1395330 - DNA, 22 bp, Artificial Sequence
  chemically synthesized
gtaagatgaataaaaattgatc

SEQ ID NO: 1395331 - DNA, 22 bp, Artificial Sequence
  chemically synthesized
agtaagatgaataaaaattgat

SEQ ID NO: 1395332 - DNA, 22 bp, Artificial Sequence
  chemically synthesized
ttataatgtgatcaatttttat

SEQ ID NO: 1395333 - DNA, 22 bp, Artificial Sequence
  chemically synthesized
tataatgtgatcaatttttatt

SEQ ID NO: 1395334 - DNA, 22 bp, Artificial Sequence
  chemically synthesized
ataatgtgatcaatttttattc

SEQ ID NO: 1395335 - DNA, 22 bp, Artificial Sequence
  chemically synthesized
taatgtgatcaatttttattca

SEQ ID NO: 1395336 - DNA, 22 bp, Artificial Sequence
  chemically synthesized
aagaatatttagtaagatgaat

SEQ ID NO: 1395337 - DNA, 22 bp, Artificial Sequence
  chemically synthesized
caagaatatttagtaagatgaa

SEQ ID NO: 1395338 - DNA, 22 bp, Artificial Sequence
  chemically synthesized
tcaagaatatttagtaagatga

SEQ ID NO: 1395339 - DNA, 22 bp, Artificial Sequence
  chemically synthesized
tgttttcaagaatatttagtaa

SEQ ID NO: 1395340 - DNA, 22 bp, Artificial Sequence
  chemically synthesized
ttattcatcttactaaatattc

SEQ ID NO: 1395341 - DNA, 22 bp, Artificial Sequence
  chemically synthesized
tattcatcttactaaatattct

SEQ ID NO: 1395342 - DNA, 22 bp, Artificial Sequence
  chemically synthesized
attcatcttactaaatattctt

SEQ ID NO: 1395343 - DNA, 22 bp, Artificial Sequence
  chemically synthesized
ttcatcttactaaatattcttg

SEQ ID NO: 1395344 - DNA, 22 bp, Artificial Sequence
  chemically synthesized
aaattatgttttcaagaatatt

SEQ ID NO: 1395345 - DNA, 22 bp, Artificial Sequence
  chemically synthesized
atcttactaaatattcttgaaa

SEQ ID NO: 1395346 - DNA, 22 bp, Artificial Sequence
  chemically synthesized
ttaaaattatgttttcaagaat

SEQ ID NO: 1395347 - DNA, 22 bp, Artificial Sequence
  chemically synthesized
attaaaattatgttttcaagaa

SEQ ID NO: 1395348 - DNA, 22 bp, Artificial Sequence
  chemically synthesized
actaaatattcttgaaaacata

SEQ ID NO: 1395349 - DNA, 22 bp, Artificial Sequence
  chemically synthesized
ctaaatattcttgaaaacataa

SEQ ID NO: 1395350 - DNA, 22 bp, Artificial Sequence
  chemically synthesized
agcacttattaaaattatgttt

SEQ ID NO: 1395351 - DNA, 22 bp, Artificial Sequence
  chemically synthesized
aatattcttgaaaacataattt

SEQ ID NO: 1395352 - DNA, 22 bp, Artificial Sequence
  chemically synthesized
ttgaaaacataattttaataag

SEQ ID NO: 1395353 - DNA, 22 bp, Artificial Sequence
  chemically synthesized
gaaaacataattttaataagtg

SEQ ID NO: 1395354 - DNA, 22 bp, Artificial Sequence
  chemically synthesized
aaaacataattttaataagtgc

SEQ ID NO: 1395355 - DNA, 22 bp, Artificial Sequence
  chemically synthesized
caacggaacattaagcacttat

SEQ ID NO: 1395356 - DNA, 22 bp, Artificial Sequence
  chemically synthesized
ttgcaacggaacattaagcact

SEQ ID NO: 1395357 - DNA, 22 bp, Artificial Sequence
  chemically synthesized
taataagtgcttaatgttccgt

SEQ ID NO: 1395358 - DNA, 22 bp, Artificial Sequence
  chemically synthesized
aataagtgcttaatgttccgtt

SEQ ID NO: 1395359 - DNA, 22 bp, Artificial Sequence
  chemically synthesized
ataagtgcttaatgttccgttg

SEQ ID NO: 1395360 - DNA, 22 bp, Artificial Sequence
  chemically synthesized
gcatatctgttgcaacggaaca

SEQ ID NO: 1395361 - DNA, 22 bp, Artificial Sequence
  chemically synthesized
ggcatatctgttgcaacggaac

SEQ ID NO: 1395362 - DNA, 22 bp, Artificial Sequence
  chemically synthesized
aatgttccgttgcaacagatat

SEQ ID NO: 1395363 - DNA, 22 bp, Artificial Sequence
  chemically synthesized
atgttccgttgcaacagatatg

SEQ ID NO: 1395364 - DNA, 22 bp, Artificial Sequence
  chemically synthesized
cgttgcaacagatatgccaaga

SEQ ID NO: 1395365 - DNA, 22 bp, Artificial Sequence
  chemically synthesized
caacagatatgccaagatttgt

SEQ ID NO: 1395366 - DNA, 22 bp, Artificial Sequence
  chemically synthesized
aaaaataagggtcagataaaca

SEQ ID NO: 1395367 - DNA, 22 bp, Artificial Sequence
  chemically synthesized
agtagctgaaaaataagggtca

SEQ ID NO: 1395368 - DNA, 22 bp, Artificial Sequence
  chemically synthesized
gtttatctgacccttatttttc

SEQ ID NO: 1395369 - DNA, 22 bp, Artificial Sequence
  chemically synthesized
tttatctgacccttatttttca

SEQ ID NO: 1395370 - DNA, 22 bp, Artificial Sequence
  chemically synthesized
atctgacccttatttttcagct

SEQ ID NO: 1395371 - DNA, 22 bp, Artificial Sequence
  chemically synthesized
tctgacccttatttttcagcta

SEQ ID NO: 1395372 - DNA, 22 bp, Artificial Sequence
  chemically synthesized
acccttatttttcagctactta

SEQ ID NO: 1395373 - DNA, 22 bp, Artificial Sequence
  chemically synthesized
atttttcagctacttaggttgc

SEQ ID NO: 1395374 - DNA, 22 bp, Artificial Sequence
  chemically synthesized
tttttcagctacttaggttgct

SEQ ID NO: 1395375 - DNA, 22 bp, Artificial Sequence
  chemically synthesized
ttcagctacttaggttgctggt

SEQ ID NO: 1395376 - DNA, 22 bp, Artificial Sequence
  chemically synthesized
tcagctacttaggttgctggtc

SEQ ID NO: 1395377 - DNA, 22 bp, Artificial Sequence
  chemically synthesized
cagctacttaggttgctggtca

SEQ ID NO: 1395378 - DNA, 22 bp, Artificial Sequence
  chemically synthesized
agctacttaggttgctggtcat

SEQ ID NO: 1395379 - DNA, 22 bp, Artificial Sequence
  chemically synthesized
agaaaagtggaaatgaccagca

SEQ ID NO: 1395380 - DNA, 22 bp, Artificial Sequence
  chemically synthesized
aagaaaagtggaaatgaccagc

SEQ ID NO: 1395381 - DNA, 22 bp, Artificial Sequence
  chemically synthesized
taagaaaagtggaaatgaccag

SEQ ID NO: 1395382 - DNA, 22 bp, Artificial Sequence
  chemically synthesized
ttaagaaaagtggaaatgacca

SEQ ID NO: 1395383 - DNA, 22 bp, Artificial Sequence
  chemically synthesized
cttaggttgctggtcatttcca

SEQ ID NO: 1395384 - DNA, 22 bp, Artificial Sequence
  chemically synthesized
cttttaagaaaagtggaaatga

SEQ ID NO: 1395385 - DNA, 22 bp, Artificial Sequence
  chemically synthesized
aggttgctggtcatttccactt

SEQ ID NO: 1395386 - DNA, 22 bp, Artificial Sequence
  chemically synthesized
ggttgctggtcatttccacttt

SEQ ID NO: 1395387 - DNA, 22 bp, Artificial Sequence
  chemically synthesized
tgttacttttaagaaaagtgga

SEQ ID NO: 1395388 - DNA, 22 bp, Artificial Sequence
  chemically synthesized
ctggtcatttccacttttctta

SEQ ID NO: 1395389 - DNA, 22 bp, Artificial Sequence
  chemically synthesized
ctatgttacttttaagaaaagt

SEQ ID NO: 1395390 - DNA, 22 bp, Artificial Sequence
  chemically synthesized
gctatgttacttttaagaaaag

SEQ ID NO: 1395391 - DNA, 22 bp, Artificial Sequence
  chemically synthesized
tgctatgttacttttaagaaaa

SEQ ID NO: 1395392 - DNA, 22 bp, Artificial Sequence
  chemically synthesized
gtcatttccacttttcttaaaa

SEQ ID NO: 1395393 - DNA, 22 bp, Artificial Sequence
  chemically synthesized
tttgctatgttacttttaagaa

SEQ ID NO: 1395394 - DNA, 22 bp, Artificial Sequence
  chemically synthesized
ttctttgctatgttacttttaa

SEQ ID NO: 1395395 - DNA, 22 bp, Artificial Sequence
  chemically synthesized
ccacttttcttaaaagtaacat

SEQ ID NO: 1395396 - DNA, 22 bp, Artificial Sequence
  chemically synthesized
cacttttcttaaaagtaacata

SEQ ID NO: 1395397 - DNA, 22 bp, Artificial Sequence
  chemically synthesized
ttcttaaaagtaacatagcaaa

SEQ ID NO: 1395398 - DNA, 22 bp, Artificial Sequence
  chemically synthesized
tcttaaaagtaacatagcaaag

SEQ ID NO: 1395399 - DNA, 22 bp, Artificial Sequence
  chemically synthesized
cttaaaagtaacatagcaaaga

SEQ ID NO: 1395400 - DNA, 22 bp, Artificial Sequence
  chemically synthesized
ttaaaagtaacatagcaaagaa

SEQ ID NO: 1395401 - DNA, 22 bp, Artificial Sequence
  chemically synthesized
aaaagtaacatagcaaagaata

SEQ ID NO: 1395402 - DNA, 22 bp, Artificial Sequence
  chemically synthesized
aaagtaacatagcaaagaataa

SEQ ID NO: 1395403 - DNA, 22 bp, Artificial Sequence
  chemically synthesized
aatagtatggacaaggttattc

SEQ ID NO: 1395404 - DNA, 22 bp, Artificial Sequence
  chemically synthesized
aagacatgattaaatagtatgg

SEQ ID NO: 1395405 - DNA, 22 bp, Artificial Sequence
  chemically synthesized
cctaaagacatgattaaatagt

SEQ ID NO: 1395406 - DNA, 22 bp, Artificial Sequence
  chemically synthesized
ccctaaagacatgattaaatag

SEQ ID NO: 1395407 - DNA, 22 bp, Artificial Sequence
  chemically synthesized
ttccctaaagacatgattaaat

SEQ ID NO: 1395408 - DNA, 22 bp, Artificial Sequence
  chemically synthesized
gtccatactatttaatcatgtc

SEQ ID NO: 1395409 - DNA, 22 bp, Artificial Sequence
  chemically synthesized
tccatactatttaatcatgtct

SEQ ID NO: 1395410 - DNA, 22 bp, Artificial Sequence
  chemically synthesized
agactcttccctaaagacatga

SEQ ID NO: 1395411 - DNA, 22 bp, Artificial Sequence
  chemically synthesized
tgagactcttccctaaagacat

SEQ ID NO: 1395412 - DNA, 22 bp, Artificial Sequence
  chemically synthesized
ctgagactcttccctaaagaca

SEQ ID NO: 1395413 - DNA, 22 bp, Artificial Sequence
  chemically synthesized
tttaatcatgtctttagggaag

SEQ ID NO: 1395414 - DNA, 22 bp, Artificial Sequence
  chemically synthesized
tcttctgagactcttccctaaa

SEQ ID NO: 1395415 - DNA, 22 bp, Artificial Sequence
  chemically synthesized
gtcttctgagactcttccctaa

SEQ ID NO: 1395416 - DNA, 22 bp, Artificial Sequence
  chemically synthesized
aatcatgtctttagggaagagt

SEQ ID NO: 1395417 - DNA, 22 bp, Artificial Sequence
  chemically synthesized
atcatgtctttagggaagagtc

SEQ ID NO: 1395418 - DNA, 22 bp, Artificial Sequence
  chemically synthesized
tagggaagagtctcagaagaca

SEQ ID NO: 1395419 - DNA, 22 bp, Artificial Sequence
  chemically synthesized
agggaagagtctcagaagacaa

SEQ ID NO: 1395420 - DNA, 22 bp, Artificial Sequence
  chemically synthesized
tgacccagcaatttgtcttctg

SEQ ID NO: 1395421 - DNA, 22 bp, Artificial Sequence
  chemically synthesized
gggaagagtctcagaagacaaa

SEQ ID NO: 1395422 - DNA, 22 bp, Artificial Sequence
  chemically synthesized
accctatgacccagcaatttgt

SEQ ID NO: 1395423 - DNA, 22 bp, Artificial Sequence
  chemically synthesized
gaccctatgacccagcaatttg

SEQ ID NO: 1395424 - DNA, 22 bp, Artificial Sequence
  chemically synthesized
agaagacaaattgctgggtcat

SEQ ID NO: 1395425 - DNA, 22 bp, Artificial Sequence
  chemically synthesized
ctgggtcatagggtcaaataca

SEQ ID NO: 1395426 - DNA, 22 bp, Artificial Sequence
  chemically synthesized
ggtcatagggtcaaatacactc

SEQ ID NO: 1395427 - DNA, 22 bp, Artificial Sequence
  chemically synthesized
gcaatatgcataaagagtgtat

SEQ ID NO: 1395428 - DNA, 22 bp, Artificial Sequence
  chemically synthesized
ggcaatatgcataaagagtgta

SEQ ID NO: 1395429 - DNA, 22 bp, Artificial Sequence
  chemically synthesized
tggcaatatgcataaagagtgt

SEQ ID NO: 1395430 - DNA, 22 bp, Artificial Sequence
  chemically synthesized
aaagcattttggcaatatgcat

SEQ ID NO: 1395431 - DNA, 22 bp, Artificial Sequence
  chemically synthesized
gaaagcattttggcaatatgca

SEQ ID NO: 1395432 - DNA, 22 bp, Artificial Sequence
  chemically synthesized
tgaaagcattttggcaatatgc

SEQ ID NO: 1395433 - DNA, 22 bp, Artificial Sequence
  chemically synthesized
ttgaaagcattttggcaatatg

SEQ ID NO: 1395434 - DNA, 22 bp, Artificial Sequence
  chemically synthesized
tttatgcatattgccaaaatgc

SEQ ID NO: 1395435 - DNA, 22 bp, Artificial Sequence
  chemically synthesized
atggtttttgaaagcattttgg

SEQ ID NO: 1395436 - DNA, 22 bp, Artificial Sequence
  chemically synthesized
tatgcatattgccaaaatgctt

SEQ ID NO: 1395437 - DNA, 22 bp, Artificial Sequence
  chemically synthesized
atgcatattgccaaaatgcttt

SEQ ID NO: 1395438 - DNA, 22 bp, Artificial Sequence
  chemically synthesized
tgcatattgccaaaatgctttc

SEQ ID NO: 1395439 - DNA, 22 bp, Artificial Sequence
  chemically synthesized
ccaaaatgctttcaaaaaccat

SEQ ID NO: 1395440 - DNA, 22 bp, Artificial Sequence
  chemically synthesized
taaatcagtctaatggtttttg

SEQ ID NO: 1395441 - DNA, 22 bp, Artificial Sequence
  chemically synthesized
gtgaggttataaatcagtctaa

SEQ ID NO: 1395442 - DNA, 22 bp, Artificial Sequence
  chemically synthesized
tcaaaaaccattagactgattt

SEQ ID NO: 1395443 - DNA, 22 bp, Artificial Sequence
  chemically synthesized
caaaaaccattagactgattta

SEQ ID NO: 1395444 - DNA, 22 bp, Artificial Sequence
  chemically synthesized
ttggtgaggttataaatcagtc

SEQ ID NO: 1395445 - DNA, 22 bp, Artificial Sequence
  chemically synthesized
aaaaaccattagactgatttat

SEQ ID NO: 1395446 - DNA, 22 bp, Artificial Sequence
  chemically synthesized
gttggtgaggttataaatcagt

SEQ ID NO: 1395447 - DNA, 22 bp, Artificial Sequence
  chemically synthesized
ttgttggtgaggttataaatca

SEQ ID NO: 1395448 - DNA, 22 bp, Artificial Sequence
  chemically synthesized
cttgttggtgaggttataaatc

SEQ ID NO: 1395449 - DNA, 22 bp, Artificial Sequence
  chemically synthesized
tcttgttggtgaggttataaat

SEQ ID NO: 1395450 - DNA, 22 bp, Artificial Sequence
  chemically synthesized
gactgatttataacctcaccaa

SEQ ID NO: 1395451 - DNA, 22 bp, Artificial Sequence
  chemically synthesized
atttataacctcaccaacaaga

SEQ ID NO: 1395452 - DNA, 22 bp, Artificial Sequence
  chemically synthesized
ataacctcaccaacaagaaagg

SEQ ID NO: 1395453 - DNA, 22 bp, Artificial Sequence
  chemically synthesized
taacctcaccaacaagaaaggg

SEQ ID NO: 1395454 - DNA, 22 bp, Artificial Sequence
  chemically synthesized
accaacaagaaagggcatgccc

SEQ ID NO: 1395455 - DNA, 22 bp, Artificial Sequence
  chemically synthesized
gaaatggtgaatacagtagaag

SEQ ID NO: 1395456 - DNA, 22 bp, Artificial Sequence
  chemically synthesized
cactgactcttctactgtattc

SEQ ID NO: 1395457 - DNA, 22 bp, Artificial Sequence
  chemically synthesized
actgactcttctactgtattca

SEQ ID NO: 1395458 - DNA, 22 bp, Artificial Sequence
  chemically synthesized
tcaacctagaaatggtgaatac

SEQ ID NO: 1395459 - DNA, 22 bp, Artificial Sequence
  chemically synthesized
actcttctactgtattcaccat

SEQ ID NO: 1395460 - DNA, 22 bp, Artificial Sequence
  chemically synthesized
cctatcaacctagaaatggtga

SEQ ID NO: 1395461 - DNA, 22 bp, Artificial Sequence
  chemically synthesized
ttctactgtattcaccatttct

SEQ ID NO: 1395462 - DNA, 22 bp, Artificial Sequence
  chemically synthesized
acctatcaacctagaaatggtg

SEQ ID NO: 1395463 - DNA, 22 bp, Artificial Sequence
  chemically synthesized
tacctatcaacctagaaatggt

SEQ ID NO: 1395464 - DNA, 22 bp, Artificial Sequence
  chemically synthesized
ctactgtattcaccatttctag

SEQ ID NO: 1395465 - DNA, 22 bp, Artificial Sequence
  chemically synthesized
tactgtattcaccatttctagg

SEQ ID NO: 1395466 - DNA, 22 bp, Artificial Sequence
  chemically synthesized
ctgtattcaccatttctaggtt

SEQ ID NO: 1395467 - DNA, 22 bp, Artificial Sequence
  chemically synthesized
tattcaccatttctaggttgat

SEQ ID NO: 1395468 - DNA, 22 bp, Artificial Sequence
  chemically synthesized
tgtaaattttacctatcaacct

SEQ ID NO: 1395469 - DNA, 22 bp, Artificial Sequence
  chemically synthesized
atgtaaattttacctatcaacc

SEQ ID NO: 1395470 - DNA, 22 bp, Artificial Sequence
  chemically synthesized
tatgtaaattttacctatcaac

SEQ ID NO: 1395471 - DNA, 22 bp, Artificial Sequence
  chemically synthesized
accatttctaggttgataggta

SEQ ID NO: 1395472 - DNA, 22 bp, Artificial Sequence
  chemically synthesized
ttatgtaaattttacctatcaa

SEQ ID NO: 1395473 - DNA, 22 bp, Artificial Sequence
  chemically synthesized
tttttatgtaaattttacctat

SEQ ID NO: 1395474 - DNA, 22 bp, Artificial Sequence
  chemically synthesized
atttttatgtaaattttaccta

SEQ ID NO: 1395475 - DNA, 22 bp, Artificial Sequence
  chemically synthesized
ctaggttgataggtaaaattta

SEQ ID NO: 1395476 - DNA, 22 bp, Artificial Sequence
  chemically synthesized
taggttgataggtaaaatttac

SEQ ID NO: 1395477 - DNA, 22 bp, Artificial Sequence
  chemically synthesized
aatttatttttatgtaaatttt

SEQ ID NO: 1395478 - DNA, 22 bp, Artificial Sequence
  chemically synthesized
ggttgataggtaaaatttacat

SEQ ID NO: 1395479 - DNA, 22 bp, Artificial Sequence
  chemically synthesized
aaatttatttttatgtaaattt

SEQ ID NO: 1395480 - DNA, 22 bp, Artificial Sequence
  chemically synthesized
taaatttatttttatgtaaatt

SEQ ID NO: 1395481 - DNA, 22 bp, Artificial Sequence
  chemically synthesized
ataggtaaaatttacataaaaa

SEQ ID NO: 1395482 - DNA, 22 bp, Artificial Sequence
  chemically synthesized
attttaaatttatttttatgta

SEQ ID NO: 1395483 - DNA, 22 bp, Artificial Sequence
  chemically synthesized
aattttaaatttatttttatgt

SEQ ID NO: 1395484 - DNA, 22 bp, Artificial Sequence
  chemically synthesized
taattttaaatttatttttatg

SEQ ID NO: 1395485 - DNA, 22 bp, Artificial Sequence
  chemically synthesized
ttaattttaaatttatttttat

SEQ ID NO: 1395486 - DNA, 22 bp, Artificial Sequence
  chemically synthesized
acataaaaataaatttaaaatt

SEQ ID NO: 1395487 - DNA, 22 bp, Artificial Sequence
  chemically synthesized
cataaaaataaatttaaaatta

SEQ ID NO: 1395488 - DNA, 22 bp, Artificial Sequence
  chemically synthesized
aatcagtagtttttaattttaa

SEQ ID NO: 1395489 - DNA, 22 bp, Artificial Sequence
  chemically synthesized
gtagaataactaaatcagtagt

SEQ ID NO: 1395490 - DNA, 22 bp, Artificial Sequence
  chemically synthesized
aaaattaaaaactactgattta

SEQ ID NO: 1395491 - DNA, 22 bp, Artificial Sequence
  chemically synthesized
aaattaaaaactactgatttag

SEQ ID NO: 1395492 - DNA, 22 bp, Artificial Sequence
  chemically synthesized
aaaactactgatttagttattc

SEQ ID NO: 1395493 - DNA, 22 bp, Artificial Sequence
  chemically synthesized
acggaattagtagaataactaa

SEQ ID NO: 1395494 - DNA, 22 bp, Artificial Sequence
  chemically synthesized
ctgatttagttattctactaat

SEQ ID NO: 1395495 - DNA, 22 bp, Artificial Sequence
  chemically synthesized
atttagttattctactaattcc

SEQ ID NO: 1395496 - DNA, 22 bp, Artificial Sequence
  chemically synthesized
agttattctactaattccgtga

SEQ ID NO: 1395497 - DNA, 22 bp, Artificial Sequence
  chemically synthesized
gttattctactaattccgtgag

SEQ ID NO: 1395498 - DNA, 22 bp, Artificial Sequence
  chemically synthesized
ttctactaattccgtgagcata

SEQ ID NO: 1395499 - DNA, 22 bp, Artificial Sequence
  chemically synthesized
tactaattccgtgagcatatct

SEQ ID NO: 1395500 - DNA, 22 bp, Artificial Sequence
  chemically synthesized
ctaattccgtgagcatatcttc

SEQ ID NO: 1395501 - DNA, 22 bp, Artificial Sequence
  chemically synthesized
attccgtgagcatatcttcata

SEQ ID NO: 1395502 - DNA, 22 bp, Artificial Sequence
  chemically synthesized
cgtgagcatatcttcatatttc

SEQ ID NO: 1395503 - DNA, 22 bp, Artificial Sequence
  chemically synthesized
ccgcaaaagaaatataaatgcc

SEQ ID NO: 1395504 - DNA, 22 bp, Artificial Sequence
  chemically synthesized
catatttcttgggcatttatat

SEQ ID NO: 1395505 - DNA, 22 bp, Artificial Sequence
  chemically synthesized
accgcaaaagaaatataaatgc

SEQ ID NO: 1395506 - DNA, 22 bp, Artificial Sequence
  chemically synthesized
atatttcttgggcatttatatt

SEQ ID NO: 1395507 - DNA, 22 bp, Artificial Sequence
  chemically synthesized
cttgggcatttatatttctttt

SEQ ID NO: 1395508 - DNA, 22 bp, Artificial Sequence
  chemically synthesized
ttgggcatttatatttcttttg

SEQ ID NO: 1395509 - DNA, 22 bp, Artificial Sequence
  chemically synthesized
gggcatttatatttcttttgcg

SEQ ID NO: 1395510 - DNA, 22 bp, Artificial Sequence
  chemically synthesized
ggcatttatatttcttttgcgg

SEQ ID NO: 1395511 - DNA, 22 bp, Artificial Sequence
  chemically synthesized
atatttcttttgcggtaagcta

SEQ ID NO: 1395512 - DNA, 22 bp, Artificial Sequence
  chemically synthesized
tatttcttttgcggtaagctat

SEQ ID NO: 1395513 - DNA, 22 bp, Artificial Sequence
  chemically synthesized
cttttgcggtaagctatttgtt

SEQ ID NO: 1395514 - DNA, 22 bp, Artificial Sequence
  chemically synthesized
ttttgcggtaagctatttgttc

SEQ ID NO: 1395515 - DNA, 22 bp, Artificial Sequence
  chemically synthesized
ttgcggtaagctatttgttctc

SEQ ID NO: 1395516 - DNA, 22 bp, Artificial Sequence
  chemically synthesized
tgcggtaagctatttgttctct

SEQ ID NO: 1395517 - DNA, 22 bp, Artificial Sequence
  chemically synthesized
gcggtaagctatttgttctctt

SEQ ID NO: 1395518 - DNA, 22 bp, Artificial Sequence
  chemically synthesized
cggtaagctatttgttctcttt

SEQ ID NO: 1395519 - DNA, 22 bp, Artificial Sequence
  chemically synthesized
tagaaaaatggaaagagtaaag

SEQ ID NO: 1395520 - DNA, 22 bp, Artificial Sequence
  chemically synthesized
tttgttctctttactctttcca

SEQ ID NO: 1395521 - DNA, 22 bp, Artificial Sequence
  chemically synthesized
gttctctttactctttccattt

SEQ ID NO: 1395522 - DNA, 22 bp, Artificial Sequence
  chemically synthesized
ttctctttactctttccatttt

SEQ ID NO: 1395523 - DNA, 22 bp, Artificial Sequence
  chemically synthesized
ataccactatagaaaaatggaa

SEQ ID NO: 1395524 - DNA, 22 bp, Artificial Sequence
  chemically synthesized
tctttactctttccatttttct

SEQ ID NO: 1395525 - DNA, 22 bp, Artificial Sequence
  chemically synthesized
ctaataccactatagaaaaatg

SEQ ID NO: 1395526 - DNA, 22 bp, Artificial Sequence
  chemically synthesized
tttactctttccatttttctat

SEQ ID NO: 1395527 - DNA, 22 bp, Artificial Sequence
  chemically synthesized
tactctttccatttttctatag

SEQ ID NO: 1395528 - DNA, 22 bp, Artificial Sequence
  chemically synthesized
actctttccatttttctatagt

SEQ ID NO: 1395529 - DNA, 22 bp, Artificial Sequence
  chemically synthesized
ctctttccatttttctatagtg

SEQ ID NO: 1395530 - DNA, 22 bp, Artificial Sequence
  chemically synthesized
tttccatttttctatagtggta

SEQ ID NO: 1395531 - DNA, 22 bp, Artificial Sequence
  chemically synthesized
tccatttttctatagtggtatt

SEQ ID NO: 1395532 - DNA, 22 bp, Artificial Sequence
  chemically synthesized
ccatttttctatagtggtatta

SEQ ID NO: 1395533 - DNA, 22 bp, Artificial Sequence
  chemically synthesized
catttttctatagtggtattag

SEQ ID NO: 1395534 - DNA, 22 bp, Artificial Sequence
  chemically synthesized
ttctatagtggtattagtagtg

SEQ ID NO: 1395535 - DNA, 22 bp, Artificial Sequence
  chemically synthesized
aaaaatgtgcaacactactaat

SEQ ID NO: 1395536 - DNA, 22 bp, Artificial Sequence
  chemically synthesized
tctatagtggtattagtagtgt

SEQ ID NO: 1395537 - DNA, 22 bp, Artificial Sequence
  chemically synthesized
aaaaaatgtgcaacactactaa

SEQ ID NO: 1395538 - DNA, 22 bp, Artificial Sequence
  chemically synthesized
ctatagtggtattagtagtgtt

SEQ ID NO: 1395539 - DNA, 22 bp, Artificial Sequence
  chemically synthesized
taaaaaatgtgcaacactacta

SEQ ID NO: 1395540 - DNA, 22 bp, Artificial Sequence
  chemically synthesized
tatagtggtattagtagtgttg

SEQ ID NO: 1395541 - DNA, 22 bp, Artificial Sequence
  chemically synthesized
tttaaaaaatgtgcaacactac

SEQ ID NO: 1395542 - DNA, 22 bp, Artificial Sequence
  chemically synthesized
tagtggtattagtagtgttgca

SEQ ID NO: 1395543 - DNA, 22 bp, Artificial Sequence
  chemically synthesized
agttctttaaaaaatgtgcaac

SEQ ID NO: 1395544 - DNA, 22 bp, Artificial Sequence
  chemically synthesized
gtagtgttgcacattttttaaa

SEQ ID NO: 1395545 - DNA, 22 bp, Artificial Sequence
  chemically synthesized
gaaaaattaagttctttaaaaa

SEQ ID NO: 1395546 - DNA, 22 bp, Artificial Sequence
  chemically synthesized
tagaaaaattaagttctttaaa

SEQ ID NO: 1395547 - DNA, 22 bp, Artificial Sequence
  chemically synthesized
ctctagaaaaattaagttcttt

SEQ ID NO: 1395548 - DNA, 22 bp, Artificial Sequence
  chemically synthesized
cacattttttaaagaacttaat

SEQ ID NO: 1395549 - DNA, 22 bp, Artificial Sequence
  chemically synthesized
atactactctagaaaaattaag

SEQ ID NO: 1395550 - DNA, 22 bp, Artificial Sequence
  chemically synthesized
tttaaagaacttaatttttcta

SEQ ID NO: 1395551 - DNA, 22 bp, Artificial Sequence
  chemically synthesized
ttaaagaacttaatttttctag

SEQ ID NO: 1395552 - DNA, 22 bp, Artificial Sequence
  chemically synthesized
taaagaacttaatttttctaga

SEQ ID NO: 1395553 - DNA, 22 bp, Artificial Sequence
  chemically synthesized
aaagaacttaatttttctagag

SEQ ID NO: 1395554 - DNA, 22 bp, Artificial Sequence
  chemically synthesized
aagaacttaatttttctagagt

SEQ ID NO: 1395555 - DNA, 22 bp, Artificial Sequence
  chemically synthesized
tgacgctaatactactctagaa

SEQ ID NO: 1395556 - DNA, 22 bp, Artificial Sequence
  chemically synthesized
ctgtgacgctaatactactcta

SEQ ID NO: 1395557 - DNA, 22 bp, Artificial Sequence
  chemically synthesized
gctgtgacgctaatactactct

SEQ ID NO: 1395558 - DNA, 22 bp, Artificial Sequence
  chemically synthesized
tgctgtgacgctaatactactc

SEQ ID NO: 1395559 - DNA, 22 bp, Artificial Sequence
  chemically synthesized
aatttttctagagtagtattag

SEQ ID NO: 1395560 - DNA, 22 bp, Artificial Sequence
  chemically synthesized
atttttctagagtagtattagc

SEQ ID NO: 1395561 - DNA, 22 bp, Artificial Sequence
  chemically synthesized
aattttgctgtgacgctaatac

SEQ ID NO: 1395562 - DNA, 22 bp, Artificial Sequence
  chemically synthesized
ttctagagtagtattagcgtca

SEQ ID NO: 1395563 - DNA, 22 bp, Artificial Sequence
  chemically synthesized
tcaattttgctgtgacgctaat

SEQ ID NO: 1395564 - DNA, 22 bp, Artificial Sequence
  chemically synthesized
tctagagtagtattagcgtcac

SEQ ID NO: 1395565 - DNA, 22 bp, Artificial Sequence
  chemically synthesized
ctagagtagtattagcgtcaca

SEQ ID NO: 1395566 - DNA, 22 bp, Artificial Sequence
  chemically synthesized
tagagtagtattagcgtcacag

SEQ ID NO: 1395567 - DNA, 22 bp, Artificial Sequence
  chemically synthesized
ctctcaattttgctgtgacgct

SEQ ID NO: 1395568 - DNA, 22 bp, Artificial Sequence
  chemically synthesized
cctctcaattttgctgtgacgc

SEQ ID NO: 1395569 - DNA, 22 bp, Artificial Sequence
  chemically synthesized
gagtagtattagcgtcacagca

SEQ ID NO: 1395570 - DNA, 22 bp, Artificial Sequence
  chemically synthesized
taccttcctctcaattttgctg

SEQ ID NO: 1395571 - DNA, 22 bp, Artificial Sequence
  chemically synthesized
tgtaccttcctctcaattttgc

SEQ ID NO: 1395572 - DNA, 22 bp, Artificial Sequence
  chemically synthesized
gcgtcacagcaaaattgagagg

SEQ ID NO: 1395573 - DNA, 22 bp, Artificial Sequence
  chemically synthesized
agaggaaggtacagagatttct

SEQ ID NO: 1395574 - DNA, 22 bp, Artificial Sequence
  chemically synthesized
tacgtgtgtggaggcaggggat

SEQ ID NO: 1395575 - DNA, 22 bp, Artificial Sequence
  chemically synthesized
ctcatatatcccctgcctccac

SEQ ID NO: 1395576 - DNA, 22 bp, Artificial Sequence
  chemically synthesized
tcatatatcccctgcctccaca

SEQ ID NO: 1395577 - DNA, 22 bp, Artificial Sequence
  chemically synthesized
atatatcccctgcctccacaca

SEQ ID NO: 1395578 - DNA, 22 bp, Artificial Sequence
  chemically synthesized
cctccacacacgtacagccacc

SEQ ID NO: 1395579 - DNA, 22 bp, Artificial Sequence
  chemically synthesized
cacacacgtacagccacccacg

SEQ ID NO: 1395580 - DNA, 22 bp, Artificial Sequence
  chemically synthesized
gtgggagatgtagatagcgtgg

SEQ ID NO: 1395581 - DNA, 22 bp, Artificial Sequence
  chemically synthesized
taacaaatgtacccgtctggtg

SEQ ID NO: 1395582 - DNA, 22 bp, Artificial Sequence
  chemically synthesized
tctacatctcccaccagacggg

SEQ ID NO: 1395583 - DNA, 22 bp, Artificial Sequence
  chemically synthesized
catctcccaccagacgggtaca

SEQ ID NO: 1395584 - DNA, 22 bp, Artificial Sequence
  chemically synthesized
atcaattgtaacaaatgtaccc

SEQ ID NO: 1395585 - DNA, 22 bp, Artificial Sequence
  chemically synthesized
ccaccagacgggtacatttgtt

SEQ ID NO: 1395586 - DNA, 22 bp, Artificial Sequence
  chemically synthesized
tcaatataggttcatcaattgt

SEQ ID NO: 1395587 - DNA, 22 bp, Artificial Sequence
  chemically synthesized
gtcaatataggttcatcaattg

SEQ ID NO: 1395588 - DNA, 22 bp, Artificial Sequence
  chemically synthesized
gttacaattgatgaacctatat

SEQ ID NO: 1395589 - DNA, 22 bp, Artificial Sequence
  chemically synthesized
ttacaattgatgaacctatatt

SEQ ID NO: 1395590 - DNA, 22 bp, Artificial Sequence
  chemically synthesized
caattgatgaacctatattgac

SEQ ID NO: 1395591 - DNA, 22 bp, Artificial Sequence
  chemically synthesized
gtgataatgatttgtcaatata

SEQ ID NO: 1395592 - DNA, 22 bp, Artificial Sequence
  chemically synthesized
ggtgataatgatttgtcaatat

SEQ ID NO: 1395593 - DNA, 22 bp, Artificial Sequence
  chemically synthesized
tggtgataatgatttgtcaata

SEQ ID NO: 1395594 - DNA, 22 bp, Artificial Sequence
  chemically synthesized
atgaacctatattgacaaatca

SEQ ID NO: 1395595 - DNA, 22 bp, Artificial Sequence
  chemically synthesized
tggaattttggtgataatgatt

SEQ ID NO: 1395596 - DNA, 22 bp, Artificial Sequence
  chemically synthesized
tattgacaaatcattatcacca

SEQ ID NO: 1395597 - DNA, 22 bp, Artificial Sequence
  chemically synthesized
actatggaattttggtgataat

SEQ ID NO: 1395598 - DNA, 22 bp, Artificial Sequence
  chemically synthesized
aactatggaattttggtgataa

SEQ ID NO: 1395599 - DNA, 22 bp, Artificial Sequence
  chemically synthesized
ttaactatggaattttggtgat

SEQ ID NO: 1395600 - DNA, 22 bp, Artificial Sequence
  chemically synthesized
acaaatcattatcaccaaaatt

SEQ ID NO: 1395601 - DNA, 22 bp, Artificial Sequence
  chemically synthesized
ctcttaactatggaattttggt

SEQ ID NO: 1395602 - DNA, 22 bp, Artificial Sequence
  chemically synthesized
actcttaactatggaattttgg

SEQ ID NO: 1395603 - DNA, 22 bp, Artificial Sequence
  chemically synthesized
tactcttaactatggaattttg

SEQ ID NO: 1395604 - DNA, 22 bp, Artificial Sequence
  chemically synthesized
tcaccaaaattccatagttaag

SEQ ID NO: 1395605 - DNA, 22 bp, Artificial Sequence
  chemically synthesized
catagttaagagtaaaggttca

SEQ ID NO: 1395606 - DNA, 22 bp, Artificial Sequence
  chemically synthesized
agagtaaaggttcattcttggg

SEQ ID NO: 1395607 - DNA, 22 bp, Artificial Sequence
  chemically synthesized
tccaaatccatagaatgcacaa

SEQ ID NO: 1395608 - DNA, 22 bp, Artificial Sequence
  chemically synthesized
attcttgggtgttgtgcattct

SEQ ID NO: 1395609 - DNA, 22 bp, Artificial Sequence
  chemically synthesized
gtccaaatccatagaatgcaca

SEQ ID NO: 1395610 - DNA, 22 bp, Artificial Sequence
  chemically synthesized
ttgggtgttgtgcattctatgg

SEQ ID NO: 1395611 - DNA, 22 bp, Artificial Sequence
  chemically synthesized
gggtgttgtgcattctatggat

SEQ ID NO: 1395612 - DNA, 22 bp, Artificial Sequence
  chemically synthesized
ggtgttgtgcattctatggatt

SEQ ID NO: 1395613 - DNA, 22 bp, Artificial Sequence
  chemically synthesized
tatatttgtccaaatccataga

SEQ ID NO: 1395614 - DNA, 22 bp, Artificial Sequence
  chemically synthesized
attatatatttgtccaaatcca

SEQ ID NO: 1395615 - DNA, 22 bp, Artificial Sequence
  chemically synthesized
cattatatatttgtccaaatcc

SEQ ID NO: 1395616 - DNA, 22 bp, Artificial Sequence
  chemically synthesized
tgcattctatggatttggacaa

SEQ ID NO: 1395617 - DNA, 22 bp, Artificial Sequence
  chemically synthesized
tatggatttggacaaatatata

SEQ ID NO: 1395618 - DNA, 22 bp, Artificial Sequence
  chemically synthesized
tggatttggacaaatatataat

SEQ ID NO: 1395619 - DNA, 22 bp, Artificial Sequence
  chemically synthesized
tgaatacatttcattatatatt

SEQ ID NO: 1395620 - DNA, 22 bp, Artificial Sequence
  chemically synthesized
taattgtgaatacatttcatta

SEQ ID NO: 1395621 - DNA, 22 bp, Artificial Sequence
  chemically synthesized
ggacaaatatataatgaaatgt

SEQ ID NO: 1395622 - DNA, 22 bp, Artificial Sequence
  chemically synthesized
gacaaatatataatgaaatgta

SEQ ID NO: 1395623 - DNA, 22 bp, Artificial Sequence
  chemically synthesized
taatgatgctataattgtgaat

SEQ ID NO: 1395624 - DNA, 22 bp, Artificial Sequence
  chemically synthesized
tgtaatgatgctataattgtga

SEQ ID NO: 1395625 - DNA, 22 bp, Artificial Sequence
  chemically synthesized
tctgtaatgatgctataattgt

SEQ ID NO: 1395626 - DNA, 22 bp, Artificial Sequence
  chemically synthesized
acaattatagcatcattacaga

SEQ ID NO: 1395627 - DNA, 22 bp, Artificial Sequence
  chemically synthesized
ggacagggaaattctctgtaat

SEQ ID NO: 1395628 - DNA, 22 bp, Artificial Sequence
  chemically synthesized
aggacagggaaattctctgtaa

SEQ ID NO: 1395629 - DNA, 22 bp, Artificial Sequence
  chemically synthesized
taggacagggaaattctctgta

SEQ ID NO: 1395630 - DNA, 22 bp, Artificial Sequence
  chemically synthesized
tagcatcattacagagaatttc

SEQ ID NO: 1395631 - DNA, 22 bp, Artificial Sequence
  chemically synthesized
cagagaatttccctgtcctaaa

SEQ ID NO: 1395632 - DNA, 22 bp, Artificial Sequence
  chemically synthesized
ccctgtcctaaaattcctctgg

SEQ ID NO: 1395633 - DNA, 22 bp, Artificial Sequence
  chemically synthesized
cctgtcctaaaattcctctgga

SEQ ID NO: 1395634 - DNA, 22 bp, Artificial Sequence
  chemically synthesized
tcctaaaattcctctggactct

SEQ ID NO: 1395635 - DNA, 22 bp, Artificial Sequence
  chemically synthesized
aaattcctctggactctacgta

SEQ ID NO: 1395636 - DNA, 22 bp, Artificial Sequence
  chemically synthesized
tgagggaaatgtatgaatacgt

SEQ ID NO: 1395637 - DNA, 22 bp, Artificial Sequence
  chemically synthesized
ctctggactctacgtattcata

SEQ ID NO: 1395638 - DNA, 22 bp, Artificial Sequence
  chemically synthesized
tggactctacgtattcatacat

SEQ ID NO: 1395639 - DNA, 22 bp, Artificial Sequence
  chemically synthesized
gactctacgtattcatacattt

SEQ ID NO: 1395640 - DNA, 22 bp, Artificial Sequence
  chemically synthesized
caggggctgtgagggaaatgta

SEQ ID NO: 1395641 - DNA, 22 bp, Artificial Sequence
  chemically synthesized
ccaggggctgtgagggaaatgt

SEQ ID NO: 1395642 - DNA, 22 bp, Artificial Sequence
  chemically synthesized
tacgtattcatacatttccctc

SEQ ID NO: 1395643 - DNA, 22 bp, Artificial Sequence
  chemically synthesized
tccaggggctgtgagggaaatg

SEQ ID NO: 1395644 - DNA, 22 bp, Artificial Sequence
  chemically synthesized
cgtattcatacatttccctcac

SEQ ID NO: 1395645 - DNA, 22 bp, Artificial Sequence
  chemically synthesized
atacatttccctcacagcccct

SEQ ID NO: 1395646 - DNA, 22 bp, Artificial Sequence
  chemically synthesized
aaagatcagtgttttccagggg

SEQ ID NO: 1395647 - DNA, 22 bp, Artificial Sequence
  chemically synthesized
ccctcacagcccctggaaaaca

SEQ ID NO: 1395648 - DNA, 22 bp, Artificial Sequence
  chemically synthesized
cctcacagcccctggaaaacac

SEQ ID NO: 1395649 - DNA, 22 bp, Artificial Sequence
  chemically synthesized
acagcccctggaaaacactgat

SEQ ID NO: 1395650 - DNA, 22 bp, Artificial Sequence
  chemically synthesized
tgtagacagttaaaagatcagt

SEQ ID NO: 1395651 - DNA, 22 bp, Artificial Sequence
  chemically synthesized
gaaaacactgatcttttaactg

SEQ ID NO: 1395652 - DNA, 22 bp, Artificial Sequence
  chemically synthesized
ggaaagcaaaaactatgtagac

SEQ ID NO: 1395653 - DNA, 22 bp, Artificial Sequence
  chemically synthesized
atcttttaactgtctacatagt

SEQ ID NO: 1395654 - DNA, 22 bp, Artificial Sequence
  chemically synthesized
tgggaaagcaaaaactatgtag

SEQ ID NO: 1395655 - DNA, 22 bp, Artificial Sequence
  chemically synthesized
ttaactgtctacatagtttttg

SEQ ID NO: 1395656 - DNA, 22 bp, Artificial Sequence
  chemically synthesized
taactgtctacatagtttttgc

SEQ ID NO: 1395657 - DNA, 22 bp, Artificial Sequence
  chemically synthesized
aactgtctacatagtttttgct

SEQ ID NO: 1395658 - DNA, 22 bp, Artificial Sequence
  chemically synthesized
actgtctacatagtttttgctt

SEQ ID NO: 1395659 - DNA, 22 bp, Artificial Sequence
  chemically synthesized
tctacatagtttttgctttccc

SEQ ID NO: 1395660 - DNA, 22 bp, Artificial Sequence
  chemically synthesized
catagtttttgctttcccagaa

SEQ ID NO: 1395661 - DNA, 22 bp, Artificial Sequence
  chemically synthesized
aacaatacgacattctgggaaa

SEQ ID NO: 1395662 - DNA, 22 bp, Artificial Sequence
  chemically synthesized
caacaatacgacattctgggaa

SEQ ID NO: 1395663 - DNA, 22 bp, Artificial Sequence
  chemically synthesized
ttgctttcccagaatgtcgtat

SEQ ID NO: 1395664 - DNA, 22 bp, Artificial Sequence
  chemically synthesized
tgctttcccagaatgtcgtatt

SEQ ID NO: 1395665 - DNA, 22 bp, Artificial Sequence
  chemically synthesized
tatgatttcaacaatacgacat

SEQ ID NO: 1395666 - DNA, 22 bp, Artificial Sequence
  chemically synthesized
gctttcccagaatgtcgtattg

SEQ ID NO: 1395667 - DNA, 22 bp, Artificial Sequence
  chemically synthesized
ctttcccagaatgtcgtattgt

SEQ ID NO: 1395668 - DNA, 22 bp, Artificial Sequence
  chemically synthesized
tcccagaatgtcgtattgttga

SEQ ID NO: 1395669 - DNA, 22 bp, Artificial Sequence
  chemically synthesized
cccagaatgtcgtattgttgaa

SEQ ID NO: 1395670 - DNA, 22 bp, Artificial Sequence
  chemically synthesized
ccagaatgtcgtattgttgaaa

SEQ ID NO: 1395671 - DNA, 22 bp, Artificial Sequence
  chemically synthesized
catactatatgatttcaacaat

SEQ ID NO: 1395672 - DNA, 22 bp, Artificial Sequence
  chemically synthesized
aaaaaatctacatactatatga

SEQ ID NO: 1395673 - DNA, 22 bp, Artificial Sequence
  chemically synthesized
ttgaaatcatatagtatgtaga

SEQ ID NO: 1395674 - DNA, 22 bp, Artificial Sequence
  chemically synthesized
aaatcatatagtatgtagattt

SEQ ID NO: 1395675 - DNA, 22 bp, Artificial Sequence
  chemically synthesized
tttcagatttgcttgttcactg

SEQ ID NO: 1395676 - DNA, 22 bp, Artificial Sequence
  chemically synthesized
ttcagatttgcttgttcactgg

SEQ ID NO: 1395677 - DNA, 22 bp, Artificial Sequence
  chemically synthesized
tcagatttgcttgttcactggt

SEQ ID NO: 1395678 - DNA, 22 bp, Artificial Sequence
  chemically synthesized
cagatttgcttgttcactggtt

SEQ ID NO: 1395679 - DNA, 22 bp, Artificial Sequence
  chemically synthesized
agatttgcttgttcactggttt

SEQ ID NO: 1395680 - DNA, 22 bp, Artificial Sequence
  chemically synthesized
gcttgttcactggtttcctcta

SEQ ID NO: 1395681 - DNA, 22 bp, Artificial Sequence
  chemically synthesized
cttgttcactggtttcctctat

SEQ ID NO: 1395682 - DNA, 22 bp, Artificial Sequence
  chemically synthesized
gttcactggtttcctctatgtg

SEQ ID NO: 1395683 - DNA, 22 bp, Artificial Sequence
  chemically synthesized
agccatgaaaaacacatagagg

SEQ ID NO: 1395684 - DNA, 22 bp, Artificial Sequence
  chemically synthesized
ttcactggtttcctctatgtgt

SEQ ID NO: 1395685 - DNA, 22 bp, Artificial Sequence
  chemically synthesized
ctgagccatgaaaaacacatag

SEQ ID NO: 1395686 - DNA, 22 bp, Artificial Sequence
  chemically synthesized
actggtttcctctatgtgtttt

SEQ ID NO: 1395687 - DNA, 22 bp, Artificial Sequence
  chemically synthesized
gtttcctctatgtgtttttcat

SEQ ID NO: 1395688 - DNA, 22 bp, Artificial Sequence
  chemically synthesized
cctctatgtgtttttcatggct

SEQ ID NO: 1395689 - DNA, 22 bp, Artificial Sequence
  chemically synthesized
ctctatgtgtttttcatggctc

SEQ ID NO: 1395690 - DNA, 22 bp, Artificial Sequence
  chemically synthesized
tatgtgtttttcatggctcagt

SEQ ID NO: 1395691 - DNA, 22 bp, Artificial Sequence
  chemically synthesized
tgtgtttttcatggctcagtag

SEQ ID NO: 1395692 - DNA, 22 bp, Artificial Sequence
  chemically synthesized
aaaagaaatgagctactgagcc

SEQ ID NO: 1395693 - DNA, 22 bp, Artificial Sequence
  chemically synthesized
ctaaaaagaaatgagctactga

SEQ ID NO: 1395694 - DNA, 22 bp, Artificial Sequence
  chemically synthesized
ttcatggctcagtagctcattt

SEQ ID NO: 1395695 - DNA, 22 bp, Artificial Sequence
  chemically synthesized
attgctaaaaagaaatgagcta

SEQ ID NO: 1395696 - DNA, 22 bp, Artificial Sequence
  chemically synthesized
tcatggctcagtagctcatttc

SEQ ID NO: 1395697 - DNA, 22 bp, Artificial Sequence
  chemically synthesized
catggctcagtagctcatttct

SEQ ID NO: 1395698 - DNA, 22 bp, Artificial Sequence
  chemically synthesized
atggctcagtagctcatttctt

SEQ ID NO: 1395699 - DNA, 22 bp, Artificial Sequence
  chemically synthesized
ttcattgctaaaaagaaatgag

SEQ ID NO: 1395700 - DNA, 22 bp, Artificial Sequence
  chemically synthesized
agtagctcatttctttttagca

SEQ ID NO: 1395701 - DNA, 22 bp, Artificial Sequence
  chemically synthesized
atttctttttagcaatgaataa

SEQ ID NO: 1395702 - DNA, 22 bp, Artificial Sequence
  chemically synthesized
agacaataagatgttattcatt

SEQ ID NO: 1395703 - DNA, 22 bp, Artificial Sequence
  chemically synthesized
ctttttagcaatgaataacatc

SEQ ID NO: 1395704 - DNA, 22 bp, Artificial Sequence
  chemically synthesized
tttttagcaatgaataacatct

SEQ ID NO: 1395705 - DNA, 22 bp, Artificial Sequence
  chemically synthesized
tttagcaatgaataacatctta

SEQ ID NO: 1395706 - DNA, 22 bp, Artificial Sequence
  chemically synthesized
ttagcaatgaataacatcttat

SEQ ID NO: 1395707 - DNA, 22 bp, Artificial Sequence
  chemically synthesized
tagcaatgaataacatcttatt

SEQ ID NO: 1395708 - DNA, 22 bp, Artificial Sequence
  chemically synthesized
agcaatgaataacatcttattg

SEQ ID NO: 1395709 - DNA, 22 bp, Artificial Sequence
  chemically synthesized
gcaatgaataacatcttattgt

SEQ ID NO: 1395710 - DNA, 22 bp, Artificial Sequence
  chemically synthesized
attgtctgaatgttctacatct

SEQ ID NO: 1395711 - DNA, 22 bp, Artificial Sequence
  chemically synthesized
ttgtctgaatgttctacatctt

SEQ ID NO: 1395712 - DNA, 22 bp, Artificial Sequence
  chemically synthesized
tctgaatgttctacatcttatt

SEQ ID NO: 1395713 - DNA, 22 bp, Artificial Sequence
  chemically synthesized
aatgttctacatcttatttatc

SEQ ID NO: 1395714 - DNA, 22 bp, Artificial Sequence
  chemically synthesized
agtaggtgaatggataaataag

SEQ ID NO: 1395715 - DNA, 22 bp, Artificial Sequence
  chemically synthesized
cagtaggtgaatggataaataa

SEQ ID NO: 1395716 - DNA, 22 bp, Artificial Sequence
  chemically synthesized
tacatcttatttatccattcac

SEQ ID NO: 1395717 - DNA, 22 bp, Artificial Sequence
  chemically synthesized
catcttatttatccattcacct

SEQ ID NO: 1395718 - DNA, 22 bp, Artificial Sequence
  chemically synthesized
atttatccattcacctactgaa

SEQ ID NO: 1395719 - DNA, 22 bp, Artificial Sequence
  chemically synthesized
tttatccattcacctactgaag

SEQ ID NO: 1395720 - DNA, 22 bp, Artificial Sequence
  chemically synthesized
atccattcacctactgaaggac

SEQ ID NO: 1395721 - DNA, 22 bp, Artificial Sequence
  chemically synthesized
tccattcacctactgaaggaca

SEQ ID NO: 1395722 - DNA, 22 bp, Artificial Sequence
  chemically synthesized
gaagcaaccaagatgtccttca

SEQ ID NO: 1395723 - DNA, 22 bp, Artificial Sequence
  chemically synthesized
ggaagcaaccaagatgtccttc

SEQ ID NO: 1395724 - DNA, 22 bp, Artificial Sequence
  chemically synthesized
acctactgaaggacatcttggt

SEQ ID NO: 1395725 - DNA, 22 bp, Artificial Sequence
  chemically synthesized
ccaaaatttggaagcaaccaag

SEQ ID NO: 1395726 - DNA, 22 bp, Artificial Sequence
  chemically synthesized
ctgaaggacatcttggttgctt

SEQ ID NO: 1395727 - DNA, 22 bp, Artificial Sequence
  chemically synthesized
aaggacatcttggttgcttcca

SEQ ID NO: 1395728 - DNA, 22 bp, Artificial Sequence
  chemically synthesized
atcattgccaaaatttggaagc

SEQ ID NO: 1395729 - DNA, 22 bp, Artificial Sequence
  chemically synthesized
ttcatcattgccaaaatttgga

SEQ ID NO: 1395730 - DNA, 22 bp, Artificial Sequence
  chemically synthesized
attcatcattgccaaaatttgg

SEQ ID NO: 1395731 - DNA, 22 bp, Artificial Sequence
  chemically synthesized
tattcatcattgccaaaatttg

SEQ ID NO: 1395732 - DNA, 22 bp, Artificial Sequence
  chemically synthesized
ggttgcttccaaattttggcaa

SEQ ID NO: 1395733 - DNA, 22 bp, Artificial Sequence
  chemically synthesized
gttgcttccaaattttggcaat

SEQ ID NO: 1395734 - DNA, 22 bp, Artificial Sequence
  chemically synthesized
cttccaaattttggcaatgatg

SEQ ID NO: 1395735 - DNA, 22 bp, Artificial Sequence
  chemically synthesized
tgacagctttattcatcattgc

SEQ ID NO: 1395736 - DNA, 22 bp, Artificial Sequence
  chemically synthesized
atgacagctttattcatcattg

SEQ ID NO: 1395737 - DNA, 22 bp, Artificial Sequence
  chemically synthesized
ccaaattttggcaatgatgaat

SEQ ID NO: 1395738 - DNA, 22 bp, Artificial Sequence
  chemically synthesized
caaattttggcaatgatgaata

SEQ ID NO: 1395739 - DNA, 22 bp, Artificial Sequence
  chemically synthesized
tggcaatgatgaataaagctgt

SEQ ID NO: 1395740 - DNA, 22 bp, Artificial Sequence
  chemically synthesized
ggcaatgatgaataaagctgtc

SEQ ID NO: 1395741 - DNA, 22 bp, Artificial Sequence
  chemically synthesized
gcaatgatgaataaagctgtca

SEQ ID NO: 1395742 - DNA, 22 bp, Artificial Sequence
  chemically synthesized
cacatggatgtttatgacagct

SEQ ID NO: 1395743 - DNA, 22 bp, Artificial Sequence
  chemically synthesized
tcataaacatccatgtgcaggg

SEQ ID NO: 1395744 - DNA, 22 bp, Artificial Sequence
  chemically synthesized
tgtccacacaaaaccctgcaca

SEQ ID NO: 1395745 - DNA, 22 bp, Artificial Sequence
  chemically synthesized
aaaattatgtccacacaaaacc

SEQ ID NO: 1395746 - DNA, 22 bp, Artificial Sequence
  chemically synthesized
tgtgtggacataattttcaact

SEQ ID NO: 1395747 - DNA, 22 bp, Artificial Sequence
  chemically synthesized
gtgtggacataattttcaactc

SEQ ID NO: 1395748 - DNA, 22 bp, Artificial Sequence
  chemically synthesized
tgtggacataattttcaactcc

SEQ ID NO: 1395749 - DNA, 22 bp, Artificial Sequence
  chemically synthesized
aaatgtaaaataccaaaggagt

SEQ ID NO: 1395750 - DNA, 22 bp, Artificial Sequence
  chemically synthesized
aaaatgtaaaataccaaaggag

SEQ ID NO: 1395751 - DNA, 22 bp, Artificial Sequence
  chemically synthesized
taaaatgtaaaataccaaagga

SEQ ID NO: 1395752 - DNA, 22 bp, Artificial Sequence
  chemically synthesized
aaattttaaaatgtaaaatacc

SEQ ID NO: 1395753 - DNA, 22 bp, Artificial Sequence
  chemically synthesized
tcaactcctttggtattttaca

SEQ ID NO: 1395754 - DNA, 22 bp, Artificial Sequence
  chemically synthesized
aaaattttaaaatgtaaaatac

SEQ ID NO: 1395755 - DNA, 22 bp, Artificial Sequence
  chemically synthesized
caactcctttggtattttacat

SEQ ID NO: 1395756 - DNA, 22 bp, Artificial Sequence
  chemically synthesized
aactcctttggtattttacatt

SEQ ID NO: 1395757 - DNA, 22 bp, Artificial Sequence
  chemically synthesized
ctttggtattttacattttaaa

SEQ ID NO: 1395758 - DNA, 22 bp, Artificial Sequence
  chemically synthesized
tggtattttacattttaaaatt

SEQ ID NO: 1395759 - DNA, 22 bp, Artificial Sequence
  chemically synthesized
ggtattttacattttaaaattt

SEQ ID NO: 1395760 - DNA, 22 bp, Artificial Sequence
  chemically synthesized
gtattttacattttaaaatttt

SEQ ID NO: 1395761 - DNA, 22 bp, Artificial Sequence
  chemically synthesized
tatataccacataacttaaaat

SEQ ID NO: 1395762 - DNA, 22 bp, Artificial Sequence
  chemically synthesized
tacattttaaaattttaagtta

SEQ ID NO: 1395763 - DNA, 22 bp, Artificial Sequence
  chemically synthesized
acattttaaaattttaagttat

SEQ ID NO: 1395764 - DNA, 22 bp, Artificial Sequence
  chemically synthesized
cattttaaaattttaagttatg

SEQ ID NO: 1395765 - DNA, 22 bp, Artificial Sequence
  chemically synthesized
ttatatataccacataacttaa

SEQ ID NO: 1395766 - DNA, 22 bp, Artificial Sequence
  chemically synthesized
gttatatataccacataactta

SEQ ID NO: 1395767 - DNA, 22 bp, Artificial Sequence
  chemically synthesized
taaaattttaagttatgtggta

SEQ ID NO: 1395768 - DNA, 22 bp, Artificial Sequence
  chemically synthesized
gcttgttatatataccacataa

SEQ ID NO: 1395769 - DNA, 22 bp, Artificial Sequence
  chemically synthesized
aaaattttaagttatgtggtat

SEQ ID NO: 1395770 - DNA, 22 bp, Artificial Sequence
  chemically synthesized
ggcttgttatatataccacata

SEQ ID NO: 1395771 - DNA, 22 bp, Artificial Sequence
  chemically synthesized
aaattttaagttatgtggtata

SEQ ID NO: 1395772 - DNA, 22 bp, Artificial Sequence
  chemically synthesized
tggcttgttatatataccacat

SEQ ID NO: 1395773 - DNA, 22 bp, Artificial Sequence
  chemically synthesized
ttttggcttgttatatatacca

SEQ ID NO: 1395774 - DNA, 22 bp, Artificial Sequence
  chemically synthesized
attttggcttgttatatatacc

SEQ ID NO: 1395775 - DNA, 22 bp, Artificial Sequence
  chemically synthesized
taagttatgtggtatatataac

SEQ ID NO: 1395776 - DNA, 22 bp, Artificial Sequence
  chemically synthesized
aagttatgtggtatatataaca

SEQ ID NO: 1395777 - DNA, 22 bp, Artificial Sequence
  chemically synthesized
agttatgtggtatatataacaa

SEQ ID NO: 1395778 - DNA, 22 bp, Artificial Sequence
  chemically synthesized
agcttattttggcttgttatat

SEQ ID NO: 1395779 - DNA, 22 bp, Artificial Sequence
  chemically synthesized
tgtggtatatataacaagccaa

SEQ ID NO: 1395780 - DNA, 22 bp, Artificial Sequence
  chemically synthesized
aaactaagcttattttggcttg

SEQ ID NO: 1395781 - DNA, 22 bp, Artificial Sequence
  chemically synthesized
actgaaactaagcttattttgg

SEQ ID NO: 1395782 - DNA, 22 bp, Artificial Sequence
  chemically synthesized
aactgaaactaagcttattttg

SEQ ID NO: 1395783 - DNA, 22 bp, Artificial Sequence
  chemically synthesized
ttaactgaaactaagcttattt

SEQ ID NO: 1395784 - DNA, 22 bp, Artificial Sequence
  chemically synthesized
aaaccataattcttaactgaaa

SEQ ID NO: 1395785 - DNA, 22 bp, Artificial Sequence
  chemically synthesized
aaaaccataattcttaactgaa

SEQ ID NO: 1395786 - DNA, 22 bp, Artificial Sequence
  chemically synthesized
taaaaccataattcttaactga

SEQ ID NO: 1395787 - DNA, 22 bp, Artificial Sequence
  chemically synthesized
agtttcagttaagaattatggt

SEQ ID NO: 1395788 - DNA, 22 bp, Artificial Sequence
  chemically synthesized
gaagattttaaaaccataattc

SEQ ID NO: 1395789 - DNA, 22 bp, Artificial Sequence
  chemically synthesized
gtttcagttaagaattatggtt

SEQ ID NO: 1395790 - DNA, 22 bp, Artificial Sequence
  chemically synthesized
agaagattttaaaaccataatt

SEQ ID NO: 1395791 - DNA, 22 bp, Artificial Sequence
  chemically synthesized
cagttaagaattatggttttaa

SEQ ID NO: 1395792 - DNA, 22 bp, Artificial Sequence
  chemically synthesized
agttaagaattatggttttaaa

SEQ ID NO: 1395793 - DNA, 22 bp, Artificial Sequence
  chemically synthesized
atcttagaagattttaaaacca

SEQ ID NO: 1395794 - DNA, 22 bp, Artificial Sequence
  chemically synthesized
aatcttagaagattttaaaacc

SEQ ID NO: 1395795 - DNA, 22 bp, Artificial Sequence
  chemically synthesized
taatcttagaagattttaaaac

SEQ ID NO: 1395796 - DNA, 22 bp, Artificial Sequence
  chemically synthesized
agaattatggttttaaaatctt

SEQ ID NO: 1395797 - DNA, 22 bp, Artificial Sequence
  chemically synthesized
tcattttaatcttagaagattt

SEQ ID NO: 1395798 - DNA, 22 bp, Artificial Sequence
  chemically synthesized
atcattttaatcttagaagatt

SEQ ID NO: 1395799 - DNA, 22 bp, Artificial Sequence
  chemically synthesized
tatcattttaatcttagaagat

SEQ ID NO: 1395800 - DNA, 22 bp, Artificial Sequence
  chemically synthesized
tggttttaaaatcttctaagat

SEQ ID NO: 1395801 - DNA, 22 bp, Artificial Sequence
  chemically synthesized
ttttatcattttaatcttagaa

SEQ ID NO: 1395802 - DNA, 22 bp, Artificial Sequence
  chemically synthesized
attttatcattttaatcttaga

SEQ ID NO: 1395803 - DNA, 22 bp, Artificial Sequence
  chemically synthesized
tattttatcattttaatcttag

SEQ ID NO: 1395804 - DNA, 22 bp, Artificial Sequence
  chemically synthesized
taaaatcttctaagattaaaat

SEQ ID NO: 1395805 - DNA, 22 bp, Artificial Sequence
  chemically synthesized
aaaatcttctaagattaaaatg

SEQ ID NO: 1395806 - DNA, 22 bp, Artificial Sequence
  chemically synthesized
gctttattttatcattttaatc

SEQ ID NO: 1395807 - DNA, 22 bp, Artificial Sequence
  chemically synthesized
aaatcttctaagattaaaatga

SEQ ID NO: 1395808 - DNA, 22 bp, Artificial Sequence
  chemically synthesized
ctaagattaaaatgataaaata

SEQ ID NO: 1395809 - DNA, 22 bp, Artificial Sequence
  chemically synthesized
taagattaaaatgataaaataa

SEQ ID NO: 1395810 - DNA, 22 bp, Artificial Sequence
  chemically synthesized
agattaaaatgataaaataaag

SEQ ID NO: 1395811 - DNA, 22 bp, Artificial Sequence
  chemically synthesized
aaatgataaaataaagccaaca

SEQ ID NO: 1395812 - DNA, 22 bp, Artificial Sequence
  chemically synthesized
ggtggaaagaagaatgttggct

SEQ ID NO: 1395813 - DNA, 22 bp, Artificial Sequence
  chemically synthesized
cggtggaaagaagaatgttggc

SEQ ID NO: 1395814 - DNA, 22 bp, Artificial Sequence
  chemically synthesized
ttcggtggaaagaagaatgttg

SEQ ID NO: 1395815 - DNA, 22 bp, Artificial Sequence
  chemically synthesized
tatgtaagtctcttcggtggaa

SEQ ID NO: 1395816 - DNA, 22 bp, Artificial Sequence
  chemically synthesized
tattatatgtaagtctcttcgg

SEQ ID NO: 1395817 - DNA, 22 bp, Artificial Sequence
  chemically synthesized
gtattatatgtaagtctcttcg

SEQ ID NO: 1395818 - DNA, 22 bp, Artificial Sequence
  chemically synthesized
ttctttccaccgaagagactta

SEQ ID NO: 1395819 - DNA, 22 bp, Artificial Sequence
  chemically synthesized
ctttccaccgaagagacttaca

SEQ ID NO: 1395820 - DNA, 22 bp, Artificial Sequence
  chemically synthesized
tttccaccgaagagacttacat

SEQ ID NO: 1395821 - DNA, 22 bp, Artificial Sequence
  chemically synthesized
aatttgtattatatgtaagtct

SEQ ID NO: 1395822 - DNA, 22 bp, Artificial Sequence
  chemically synthesized
tccaccgaagagacttacatat

SEQ ID NO: 1395823 - DNA, 22 bp, Artificial Sequence
  chemically synthesized
tgaatttgtattatatgtaagt

SEQ ID NO: 1395824 - DNA, 22 bp, Artificial Sequence
  chemically synthesized
ccaccgaagagacttacatata

SEQ ID NO: 1395825 - DNA, 22 bp, Artificial Sequence
  chemically synthesized
ctgaatttgtattatatgtaag

SEQ ID NO: 1395826 - DNA, 22 bp, Artificial Sequence
  chemically synthesized
caccgaagagacttacatataa

SEQ ID NO: 1395827 - DNA, 22 bp, Artificial Sequence
  chemically synthesized
acatataatacaaattcagaag

SEQ ID NO: 1395828 - DNA, 22 bp, Artificial Sequence
  chemically synthesized
ggagacataaaacttctgaatt

SEQ ID NO: 1395829 - DNA, 22 bp, Artificial Sequence
  chemically synthesized
catataatacaaattcagaagt

SEQ ID NO: 1395830 - DNA, 22 bp, Artificial Sequence
  chemically synthesized
tgtaatctaggagacataaaac

SEQ ID NO: 1395831 - DNA, 22 bp, Artificial Sequence
  chemically synthesized
gtgtaatctaggagacataaaa

SEQ ID NO: 1395832 - DNA, 22 bp, Artificial Sequence
  chemically synthesized
agaagttttatgtctcctagat

SEQ ID NO: 1395833 - DNA, 22 bp, Artificial Sequence
  chemically synthesized
cccaggatttgtgtaatctagg

SEQ ID NO: 1395834 - DNA, 22 bp, Artificial Sequence
  chemically synthesized
ttacccaggatttgtgtaatct

SEQ ID NO: 1395835 - DNA, 22 bp, Artificial Sequence
  chemically synthesized
tatgtctcctagattacacaaa

SEQ ID NO: 1395836 - DNA, 22 bp, Artificial Sequence
  chemically synthesized
atgtctcctagattacacaaat

SEQ ID NO: 1395837 - DNA, 22 bp, Artificial Sequence
  chemically synthesized
ctattacccaggatttgtgtaa

SEQ ID NO: 1395838 - DNA, 22 bp, Artificial Sequence
  chemically synthesized
tgtctcctagattacacaaatc

SEQ ID NO: 1395839 - DNA, 22 bp, Artificial Sequence
  chemically synthesized
ctagattacacaaatcctgggt

SEQ ID NO: 1395840 - DNA, 22 bp, Artificial Sequence
  chemically synthesized
gattacacaaatcctgggtaat

SEQ ID NO: 1395841 - DNA, 22 bp, Artificial Sequence
  chemically synthesized
ccatcccatattcctattaccc

SEQ ID NO: 1395842 - DNA, 22 bp, Artificial Sequence
  chemically synthesized
cccatcccatattcctattacc

SEQ ID NO: 1395843 - DNA, 22 bp, Artificial Sequence
  chemically synthesized
cacaaatcctgggtaataggaa

SEQ ID NO: 1395844 - DNA, 22 bp, Artificial Sequence
  chemically synthesized
ttcccatcccatattcctatta

SEQ ID NO: 1395845 - DNA, 22 bp, Artificial Sequence
  chemically synthesized
taattcttcccatcccatattc

SEQ ID NO: 1395846 - DNA, 22 bp, Artificial Sequence
  chemically synthesized
gtaattcttcccatcccatatt

SEQ ID NO: 1395847 - DNA, 22 bp, Artificial Sequence
  chemically synthesized
ggtaataggaatatgggatggg

SEQ ID NO: 1395848 - DNA, 22 bp, Artificial Sequence
  chemically synthesized
cataatccatttgtaattcttc

SEQ ID NO: 1395849 - DNA, 22 bp, Artificial Sequence
  chemically synthesized
caaatggattatgtagatactt

SEQ ID NO: 1395850 - DNA, 22 bp, Artificial Sequence
  chemically synthesized
tgtagatacttactgatatggt

SEQ ID NO: 1395851 - DNA, 22 bp, Artificial Sequence
  chemically synthesized
ggtggggacacagacaaaccat

SEQ ID NO: 1395852 - DNA, 22 bp, Artificial Sequence
  chemically synthesized
gggtggggacacagacaaacca

SEQ ID NO: 1395853 - DNA, 22 bp, Artificial Sequence
  chemically synthesized
actgatatggtttgtctgtgtc

SEQ ID NO: 1395854 - DNA, 22 bp, Artificial Sequence
  chemically synthesized
ctgatatggtttgtctgtgtcc

SEQ ID NO: 1395855 - DNA, 22 bp, Artificial Sequence
  chemically synthesized
atatggtttgtctgtgtcccca

SEQ ID NO: 1395856 - DNA, 22 bp, Artificial Sequence
  chemically synthesized
caagatgaaatttgggtgggga

SEQ ID NO: 1395857 - DNA, 22 bp, Artificial Sequence
  chemically synthesized
gtctgtgtccccacccaaattt

SEQ ID NO: 1395858 - DNA, 22 bp, Artificial Sequence
  chemically synthesized
tctgtgtccccacccaaatttc

SEQ ID NO: 1395859 - DNA, 22 bp, Artificial Sequence
  chemically synthesized
tgggaactacaagatgaaattt

SEQ ID NO: 1395860 - DNA, 22 bp, Artificial Sequence
  chemically synthesized
tgtccccacccaaatttcatct

SEQ ID NO: 1395861 - DNA, 22 bp, Artificial Sequence
  chemically synthesized
catcttgtagttcccataatcc

SEQ ID NO: 1395862 - DNA, 22 bp, Artificial Sequence
  chemically synthesized
atcttgtagttcccataatccc

SEQ ID NO: 1395863 - DNA, 22 bp, Artificial Sequence
  chemically synthesized
ccaccacacagggggattatgg

SEQ ID NO: 1395864 - DNA, 22 bp, Artificial Sequence
  chemically synthesized
tcccaccacacagggggattat

SEQ ID NO: 1395865 - DNA, 22 bp, Artificial Sequence
  chemically synthesized
gtagttcccataatccccctgt

SEQ ID NO: 1395866 - DNA, 22 bp, Artificial Sequence
  chemically synthesized
tagttcccataatccccctgtg

SEQ ID NO: 1395867 - DNA, 22 bp, Artificial Sequence
  chemically synthesized
ggtctctcccaccacacagggg

SEQ ID NO: 1395868 - DNA, 22 bp, Artificial Sequence
  chemically synthesized
ccataatccccctgtgtggtgg

SEQ ID NO: 1395869 - DNA, 22 bp, Artificial Sequence
  chemically synthesized
ccactgggtctctcccaccaca

SEQ ID NO: 1395870 - DNA, 22 bp, Artificial Sequence
  chemically synthesized
tctcccactgggtctctcccac

SEQ ID NO: 1395871 - DNA, 22 bp, Artificial Sequence
  chemically synthesized
agttatctcccactgggtctct

SEQ ID NO: 1395872 - DNA, 22 bp, Artificial Sequence
  chemically synthesized
tgtggtgggagagacccagtgg

SEQ ID NO: 1395873 - DNA, 22 bp, Artificial Sequence
  chemically synthesized
aatcatgggggtggtttcccca

SEQ ID NO: 1395874 - DNA, 22 bp, Artificial Sequence
  chemically synthesized
tcacaagaatagcatggggaaa

SEQ ID NO: 1395875 - DNA, 22 bp, Artificial Sequence
  chemically synthesized
ctatcacaagaatagcatgggg

SEQ ID NO: 1395876 - DNA, 22 bp, Artificial Sequence
  chemically synthesized
gctatcacaagaatagcatggg

SEQ ID NO: 1395877 - DNA, 22 bp, Artificial Sequence
  chemically synthesized
cttgctatcacaagaatagcat

SEQ ID NO: 1395878 - DNA, 22 bp, Artificial Sequence
  chemically synthesized
acttgctatcacaagaatagca

SEQ ID NO: 1395879 - DNA, 22 bp, Artificial Sequence
  chemically synthesized
ccccatgctattcttgtgatag

SEQ ID NO: 1395880 - DNA, 22 bp, Artificial Sequence
  chemically synthesized
cccatgctattcttgtgatagc

SEQ ID NO: 1395881 - DNA, 22 bp, Artificial Sequence
  chemically synthesized
atgagaacttacttgctatcac

SEQ ID NO: 1395882 - DNA, 22 bp, Artificial Sequence
  chemically synthesized
ttcttgtgatagcaagtaagtt

SEQ ID NO: 1395883 - DNA, 22 bp, Artificial Sequence
  chemically synthesized
ttgtgatagcaagtaagttctc

SEQ ID NO: 1395884 - DNA, 22 bp, Artificial Sequence
  chemically synthesized
gtgatagcaagtaagttctcat

SEQ ID NO: 1395885 - DNA, 22 bp, Artificial Sequence
  chemically synthesized
tgatagcaagtaagttctcatg

SEQ ID NO: 1395886 - DNA, 22 bp, Artificial Sequence
  chemically synthesized
taaaaccatcagatctcatgag

SEQ ID NO: 1395887 - DNA, 22 bp, Artificial Sequence
  chemically synthesized
ataaaaccatcagatctcatga

SEQ ID NO: 1395888 - DNA, 22 bp, Artificial Sequence
  chemically synthesized
tcatgagatctgatggttttat

SEQ ID NO: 1395889 - DNA, 22 bp, Artificial Sequence
  chemically synthesized
atgagatctgatggttttataa

SEQ ID NO: 1395890 - DNA, 22 bp, Artificial Sequence
  chemically synthesized
atggttttataagggacttccc

SEQ ID NO: 1395891 - DNA, 22 bp, Artificial Sequence
  chemically synthesized
tataagggacttccccctttgc

SEQ ID NO: 1395892 - DNA, 22 bp, Artificial Sequence
  chemically synthesized
ataagggacttccccctttgct

SEQ ID NO: 1395893 - DNA, 22 bp, Artificial Sequence
  chemically synthesized
taagggacttccccctttgctt

SEQ ID NO: 1395894 - DNA, 22 bp, Artificial Sequence
  chemically synthesized
ccccctttgcttggctctcatt

SEQ ID NO: 1395895 - DNA, 22 bp, Artificial Sequence
  chemically synthesized
cccctttgcttggctctcattc

SEQ ID NO: 1395896 - DNA, 22 bp, Artificial Sequence
  chemically synthesized
tgcttggctctcattcttctcc

SEQ ID NO: 1395897 - DNA, 22 bp, Artificial Sequence
  chemically synthesized
gcttggctctcattcttctcct

SEQ ID NO: 1395898 - DNA, 22 bp, Artificial Sequence
  chemically synthesized
cttggctctcattcttctcctt

SEQ ID NO: 1395899 - DNA, 22 bp, Artificial Sequence
  chemically synthesized
ggctctcattcttctccttgct

SEQ ID NO: 1395900 - DNA, 22 bp, Artificial Sequence
  chemically synthesized
gctctcattcttctccttgctg

SEQ ID NO: 1395901 - DNA, 22 bp, Artificial Sequence
  chemically synthesized
atcacatggcggcagcaaggag

SEQ ID NO: 1395902 - DNA, 22 bp, Artificial Sequence
  chemically synthesized
tcattcttctccttgctgccgc

SEQ ID NO: 1395903 - DNA, 22 bp, Artificial Sequence
  chemically synthesized
attcttctccttgctgccgcca

SEQ ID NO: 1395904 - DNA, 22 bp, Artificial Sequence
  chemically synthesized
ttctccttgctgccgccatgtg

SEQ ID NO: 1395905 - DNA, 22 bp, Artificial Sequence
  chemically synthesized
ctccttgctgccgccatgtgat

SEQ ID NO: 1395906 - DNA, 22 bp, Artificial Sequence
  chemically synthesized
tccttgctgccgccatgtgatg

SEQ ID NO: 1395907 - DNA, 22 bp, Artificial Sequence
  chemically synthesized
cttgctgccgccatgtgatgag

SEQ ID NO: 1395908 - DNA, 22 bp, Artificial Sequence
  chemically synthesized
gctgccgccatgtgatgaggat

SEQ ID NO: 1395909 - DNA, 22 bp, Artificial Sequence
  chemically synthesized
ctgccgccatgtgatgaggatg

SEQ ID NO: 1395910 - DNA, 22 bp, Artificial Sequence
  chemically synthesized
ccgccatgtgatgaggatgtgt

SEQ ID NO: 1395911 - DNA, 22 bp, Artificial Sequence
  chemically synthesized
caatcatggcagaaggggaagc

SEQ ID NO: 1395912 - DNA, 22 bp, Artificial Sequence
  chemically synthesized
acaatcatggcagaaggggaag

SEQ ID NO: 1395913 - DNA, 22 bp, Artificial Sequence
  chemically synthesized
aggaaacttacaatcatggcag

SEQ ID NO: 1395914 - DNA, 22 bp, Artificial Sequence
  chemically synthesized
gcttccccttctgccatgattg

SEQ ID NO: 1395915 - DNA, 22 bp, Artificial Sequence
  chemically synthesized
cttccccttctgccatgattgt

SEQ ID NO: 1395916 - DNA, 22 bp, Artificial Sequence
  chemically synthesized
ccccttctgccatgattgtaag

SEQ ID NO: 1395917 - DNA, 22 bp, Artificial Sequence
  chemically synthesized
cccttctgccatgattgtaagt

SEQ ID NO: 1395918 - DNA, 22 bp, Artificial Sequence
  chemically synthesized
gggaggcctcaggaaacttaca

SEQ ID NO: 1395919 - DNA, 22 bp, Artificial Sequence
  chemically synthesized
ctgccatgattgtaagtttcct

SEQ ID NO: 1395920 - DNA, 22 bp, Artificial Sequence
  chemically synthesized
tgccatgattgtaagtttcctg

SEQ ID NO: 1395921 - DNA, 22 bp, Artificial Sequence
  chemically synthesized
gctggggaggcctcaggaaact

SEQ ID NO: 1395922 - DNA, 22 bp, Artificial Sequence
  chemically synthesized
ccatgattgtaagtttcctgag

SEQ ID NO: 1395923 - DNA, 22 bp, Artificial Sequence
  chemically synthesized
agcctggctggggaggcctcag

SEQ ID NO: 1395924 - DNA, 22 bp, Artificial Sequence
  chemically synthesized
taagtttcctgaggcctcccca

SEQ ID NO: 1395925 - DNA, 22 bp, Artificial Sequence
  chemically synthesized
acagttcagcctggctggggag

SEQ ID NO: 1395926 - DNA, 22 bp, Artificial Sequence
  chemically synthesized
cctgaggcctccccagccaggc

SEQ ID NO: 1395927 - DNA, 22 bp, Artificial Sequence
  chemically synthesized
actcacagttcagcctggctgg

SEQ ID NO: 1395928 - DNA, 22 bp, Artificial Sequence
  chemically synthesized
ctgaggcctccccagccaggct

SEQ ID NO: 1395929 - DNA, 22 bp, Artificial Sequence
  chemically synthesized
aggcctccccagccaggctgaa

SEQ ID NO: 1395930 - DNA, 22 bp, Artificial Sequence
  chemically synthesized
attgactcacagttcagcctgg

SEQ ID NO: 1395931 - DNA, 22 bp, Artificial Sequence
  chemically synthesized
aattgactcacagttcagcctg

SEQ ID NO: 1395932 - DNA, 22 bp, Artificial Sequence
  chemically synthesized
cccagccaggctgaactgtgag

SEQ ID NO: 1395933 - DNA, 22 bp, Artificial Sequence
  chemically synthesized
ataaaggaaagaggtttaattg

SEQ ID NO: 1395934 - DNA, 22 bp, Artificial Sequence
  chemically synthesized
aactgtgagtcaattaaacctc

SEQ ID NO: 1395935 - DNA, 22 bp, Artificial Sequence
  chemically synthesized
tgagtcaattaaacctctttcc

SEQ ID NO: 1395936 - DNA, 22 bp, Artificial Sequence
  chemically synthesized
aacctctttcctttatgaatta

SEQ ID NO: 1395937 - DNA, 22 bp, Artificial Sequence
  chemically synthesized
tttcctttatgaattatgcatt

SEQ ID NO: 1395938 - DNA, 22 bp, Artificial Sequence
  chemically synthesized
tcctttatgaattatgcattat

SEQ ID NO: 1395939 - DNA, 22 bp, Artificial Sequence
  chemically synthesized
cctttatgaattatgcattatt

SEQ ID NO: 1395940 - DNA, 22 bp, Artificial Sequence
  chemically synthesized
ctttatgaattatgcattattg

SEQ ID NO: 1395941 - DNA, 22 bp, Artificial Sequence
  chemically synthesized
taaagaaatacccaataatgca

SEQ ID NO: 1395942 - DNA, 22 bp, Artificial Sequence
  chemically synthesized
tatgaattatgcattattgggt

SEQ ID NO: 1395943 - DNA, 22 bp, Artificial Sequence
  chemically synthesized
ctataaagaaatacccaataat

SEQ ID NO: 1395944 - DNA, 22 bp, Artificial Sequence
  chemically synthesized
atgaattatgcattattgggta

SEQ ID NO: 1395945 - DNA, 22 bp, Artificial Sequence
  chemically synthesized
tgaattatgcattattgggtat

SEQ ID NO: 1395946 - DNA, 22 bp, Artificial Sequence
  chemically synthesized
acactgctataaagaaataccc

SEQ ID NO: 1395947 - DNA, 22 bp, Artificial Sequence
  chemically synthesized
tcacactgctataaagaaatac

SEQ ID NO: 1395948 - DNA, 22 bp, Artificial Sequence
  chemically synthesized
tgcattattgggtatttcttta

SEQ ID NO: 1395949 - DNA, 22 bp, Artificial Sequence
  chemically synthesized
attctcacactgctataaagaa

SEQ ID NO: 1395950 - DNA, 22 bp, Artificial Sequence
  chemically synthesized
ttgggtatttctttatagcagt

SEQ ID NO: 1395951 - DNA, 22 bp, Artificial Sequence
  chemically synthesized
gttcattctcacactgctataa

SEQ ID NO: 1395952 - DNA, 22 bp, Artificial Sequence
  chemically synthesized
ggtatttctttatagcagtgtg

SEQ ID NO: 1395953 - DNA, 22 bp, Artificial Sequence
  chemically synthesized
agtgtattagttcattctcaca

SEQ ID NO: 1395954 - DNA, 22 bp, Artificial Sequence
  chemically synthesized
ctttatagcagtgtgagaatga

SEQ ID NO: 1395955 - DNA, 22 bp, Artificial Sequence
  chemically synthesized
tttatagcagtgtgagaatgaa

SEQ ID NO: 1395956 - DNA, 22 bp, Artificial Sequence
  chemically synthesized
tatagcagtgtgagaatgaact

SEQ ID NO: 1395957 - DNA, 22 bp, Artificial Sequence
  chemically synthesized
atagcagtgtgagaatgaacta

SEQ ID NO: 1395958 - DNA, 22 bp, Artificial Sequence
  chemically synthesized
tagcagtgtgagaatgaactaa

SEQ ID NO: 1395959 - DNA, 22 bp, Artificial Sequence
  chemically synthesized
aaaaattaagtgtattagttca

SEQ ID NO: 1395960 - DNA, 22 bp, Artificial Sequence
  chemically synthesized
aaaaaattaagtgtattagttc

SEQ ID NO: 1395961 - DNA, 22 bp, Artificial Sequence
  chemically synthesized
agacatttaaaaaattaagtgt

SEQ ID NO: 1395962 - DNA, 22 bp, Artificial Sequence
  chemically synthesized
atacacttaattttttaaatgt

SEQ ID NO: 1395963 - DNA, 22 bp, Artificial Sequence
  chemically synthesized
aaatgataaatattcagacatt

SEQ ID NO: 1395964 - DNA, 22 bp, Artificial Sequence
  chemically synthesized
gaaatgataaatattcagacat

SEQ ID NO: 1395965 - DNA, 22 bp, Artificial Sequence
  chemically synthesized
aattttttaaatgtctgaatat

SEQ ID NO: 1395966 - DNA, 22 bp, Artificial Sequence
  chemically synthesized
attttttaaatgtctgaatatt

SEQ ID NO: 1395967 - DNA, 22 bp, Artificial Sequence
  chemically synthesized
tttaaatgtctgaatatttatc

SEQ ID NO: 1395968 - DNA, 22 bp, Artificial Sequence
  chemically synthesized
ttaaatgtctgaatatttatca

SEQ ID NO: 1395969 - DNA, 22 bp, Artificial Sequence
  chemically synthesized
taaatgtctgaatatttatcat

SEQ ID NO: 1395970 - DNA, 22 bp, Artificial Sequence
  chemically synthesized
aataaatttgaaatgataaata

SEQ ID NO: 1395971 - DNA, 22 bp, Artificial Sequence
  chemically synthesized
aaatgtctgaatatttatcatt

SEQ ID NO: 1395972 - DNA, 22 bp, Artificial Sequence
  chemically synthesized
aatgtctgaatatttatcattt

SEQ ID NO: 1395973 - DNA, 22 bp, Artificial Sequence
  chemically synthesized
aatatttatcatttcaaattta

SEQ ID NO: 1395974 - DNA, 22 bp, Artificial Sequence
  chemically synthesized
atcatttcaaatttatttaatg

SEQ ID NO: 1395975 - DNA, 22 bp, Artificial Sequence
  chemically synthesized
tcatttcaaatttatttaatgt

SEQ ID NO: 1395976 - DNA, 22 bp, Artificial Sequence
  chemically synthesized
agagaggaaacaaaagacatta

SEQ ID NO: 1395977 - DNA, 22 bp, Artificial Sequence
  chemically synthesized
caaatttatttaatgtcttttg

SEQ ID NO: 1395978 - DNA, 22 bp, Artificial Sequence
  chemically synthesized
aaatttatttaatgtcttttgt

SEQ ID NO: 1395979 - DNA, 22 bp, Artificial Sequence
  chemically synthesized
tattaagagaggaaacaaaaga

SEQ ID NO: 1395980 - DNA, 22 bp, Artificial Sequence
  chemically synthesized
atttaatgtcttttgtttcctc

SEQ ID NO: 1395981 - DNA, 22 bp, Artificial Sequence
  chemically synthesized
tttaatgtcttttgtttcctct

SEQ ID NO: 1395982 - DNA, 22 bp, Artificial Sequence
  chemically synthesized
aatgtcttttgtttcctctctt

SEQ ID NO: 1395983 - DNA, 22 bp, Artificial Sequence
  chemically synthesized
atgtcttttgtttcctctctta

SEQ ID NO: 1395984 - DNA, 22 bp, Artificial Sequence
  chemically synthesized
ataaaattatattaagagagga

SEQ ID NO: 1395985 - DNA, 22 bp, Artificial Sequence
  chemically synthesized
ttgataaaattatattaagaga

SEQ ID NO: 1395986 - DNA, 22 bp, Artificial Sequence
  chemically synthesized
gttgataaaattatattaagag

SEQ ID NO: 1395987 - DNA, 22 bp, Artificial Sequence
  chemically synthesized
ttgtttcctctcttaatataat

SEQ ID NO: 1395988 - DNA, 22 bp, Artificial Sequence
  chemically synthesized
tgtttcctctcttaatataatt

SEQ ID NO: 1395989 - DNA, 22 bp, Artificial Sequence
  chemically synthesized
gtttcctctcttaatataattt

SEQ ID NO: 1395990 - DNA, 22 bp, Artificial Sequence
  chemically synthesized
tttcctctcttaatataatttt

SEQ ID NO: 1395991 - DNA, 22 bp, Artificial Sequence
  chemically synthesized
cctctcttaatataattttatc

SEQ ID NO: 1395992 - DNA, 22 bp, Artificial Sequence
  chemically synthesized
ctctcttaatataattttatca

SEQ ID NO: 1395993 - DNA, 22 bp, Artificial Sequence
  chemically synthesized
atggaaaaatttgttgataaaa

SEQ ID NO: 1395994 - DNA, 22 bp, Artificial Sequence
  chemically synthesized
tcttaatataattttatcaaca

SEQ ID NO: 1395995 - DNA, 22 bp, Artificial Sequence
  chemically synthesized
aatggaaaaatttgttgataaa

SEQ ID NO: 1395996 - DNA, 22 bp, Artificial Sequence
  chemically synthesized
ttaatataattttatcaacaaa

SEQ ID NO: 1395997 - DNA, 22 bp, Artificial Sequence
  chemically synthesized
aatataattttatcaacaaatt

SEQ ID NO: 1395998 - DNA, 22 bp, Artificial Sequence
  chemically synthesized
atttaatggaaaaatttgttga

SEQ ID NO: 1395999 - DNA, 22 bp, Artificial Sequence
  chemically synthesized
atataattttatcaacaaattt

SEQ ID NO: 1396000 - DNA, 22 bp, Artificial Sequence
  chemically synthesized
actgatttaatggaaaaatttg

SEQ ID NO: 1396001 - DNA, 22 bp, Artificial Sequence
  chemically synthesized
tatcaacaaatttttccattaa

SEQ ID NO: 1396002 - DNA, 22 bp, Artificial Sequence
  chemically synthesized
atcaacaaatttttccattaaa

SEQ ID NO: 1396003 - DNA, 22 bp, Artificial Sequence
  chemically synthesized
tcaacaaatttttccattaaat

SEQ ID NO: 1396004 - DNA, 22 bp, Artificial Sequence
  chemically synthesized
agaagattcactgatttaatgg

SEQ ID NO: 1396005 - DNA, 22 bp, Artificial Sequence
  chemically synthesized
cagaagattcactgatttaatg

SEQ ID NO: 1396006 - DNA, 22 bp, Artificial Sequence
  chemically synthesized
ttccattaaatcagtgaatctt

SEQ ID NO: 1396007 - DNA, 22 bp, Artificial Sequence
  chemically synthesized
tccattaaatcagtgaatcttc

SEQ ID NO: 1396008 - DNA, 22 bp, Artificial Sequence
  chemically synthesized
ccattaaatcagtgaatcttct

SEQ ID NO: 1396009 - DNA, 22 bp, Artificial Sequence
  chemically synthesized
cattaaatcagtgaatcttctg

SEQ ID NO: 1396010 - DNA, 22 bp, Artificial Sequence
  chemically synthesized
taataaataacttcagaagatt

SEQ ID NO: 1396011 - DNA, 22 bp, Artificial Sequence
  chemically synthesized
ataataaataacttcagaagat

SEQ ID NO: 1396012 - DNA, 22 bp, Artificial Sequence
  chemically synthesized
aatcagtgaatcttctgaagtt

SEQ ID NO: 1396013 - DNA, 22 bp, Artificial Sequence
  chemically synthesized
atatttataataaataacttca

SEQ ID NO: 1396014 - DNA, 22 bp, Artificial Sequence
  chemically synthesized
attcatatttataataaataac

SEQ ID NO: 1396015 - DNA, 22 bp, Artificial Sequence
  chemically synthesized
ctgaagttatttattataaata

SEQ ID NO: 1396016 - DNA, 22 bp, Artificial Sequence
  chemically synthesized
tgaagttatttattataaatat

SEQ ID NO: 1396017 - DNA, 22 bp, Artificial Sequence
  chemically synthesized
aagttatttattataaatatga

SEQ ID NO: 1396018 - DNA, 22 bp, Artificial Sequence
  chemically synthesized
aaaggaattaattcatatttat

SEQ ID NO: 1396019 - DNA, 22 bp, Artificial Sequence
  chemically synthesized
gaaaggaattaattcatattta

SEQ ID NO: 1396020 - DNA, 22 bp, Artificial Sequence
  chemically synthesized
tttattataaatatgaattaat

SEQ ID NO: 1396021 - DNA, 22 bp, Artificial Sequence
  chemically synthesized
attataaatatgaattaattcc

SEQ ID NO: 1396022 - DNA, 22 bp, Artificial Sequence
  chemically synthesized
ataaatttgaaaggaattaatt

SEQ ID NO: 1396023 - DNA, 22 bp, Artificial Sequence
  chemically synthesized
ttataaatatgaattaattcct

SEQ ID NO: 1396024 - DNA, 22 bp, Artificial Sequence
  chemically synthesized
taaatatgaattaattcctttc

SEQ ID NO: 1396025 - DNA, 22 bp, Artificial Sequence
  chemically synthesized
attaataaatttgaaaggaatt

SEQ ID NO: 1396026 - DNA, 22 bp, Artificial Sequence
  chemically synthesized
aaattcattaataaatttgaaa

SEQ ID NO: 1396027 - DNA, 22 bp, Artificial Sequence
  chemically synthesized
tattaaaattcattaataaatt

SEQ ID NO: 1396028 - DNA, 22 bp, Artificial Sequence
  chemically synthesized
attcctttcaaatttattaatg

SEQ ID NO: 1396029 - DNA, 22 bp, Artificial Sequence
  chemically synthesized
aattatattaaaattcattaat

SEQ ID NO: 1396030 - DNA, 22 bp, Artificial Sequence
  chemically synthesized
ctttcaaatttattaatgaatt

SEQ ID NO: 1396031 - DNA, 22 bp, Artificial Sequence
  chemically synthesized
tcaaatttattaatgaatttta

SEQ ID NO: 1396032 - DNA, 22 bp, Artificial Sequence
  chemically synthesized
caaatttattaatgaattttaa

SEQ ID NO: 1396033 - DNA, 22 bp, Artificial Sequence
  chemically synthesized
aaatttattaatgaattttaat

SEQ ID NO: 1396034 - DNA, 22 bp, Artificial Sequence
  chemically synthesized
attaatgaattttaatataatt

SEQ ID NO: 1396035 - DNA, 22 bp, Artificial Sequence
  chemically synthesized
catcatatattaaattatatta

SEQ ID NO: 1396036 - DNA, 22 bp, Artificial Sequence
  chemically synthesized
ttaatgaattttaatataattt

SEQ ID NO: 1396037 - DNA, 22 bp, Artificial Sequence
  chemically synthesized
acatcatatattaaattatatt

SEQ ID NO: 1396038 - DNA, 22 bp, Artificial Sequence
  chemically synthesized
tacatcatatattaaattatat

SEQ ID NO: 1396039 - DNA, 22 bp, Artificial Sequence
  chemically synthesized
atgaattttaatataatttaat

SEQ ID NO: 1396040 - DNA, 22 bp, Artificial Sequence
  chemically synthesized
taatataatttaatatatgatg

SEQ ID NO: 1396041 - DNA, 22 bp, Artificial Sequence
  chemically synthesized
aatataatttaatatatgatgt

SEQ ID NO: 1396042 - DNA, 22 bp, Artificial Sequence
  chemically synthesized
atataatttaatatatgatgta

SEQ ID NO: 1396043 - DNA, 22 bp, Artificial Sequence
  chemically synthesized
aaatataacatcattttacatc

SEQ ID NO: 1396044 - DNA, 22 bp, Artificial Sequence
  chemically synthesized
aatatatgatgtaaaatgatgt

SEQ ID NO: 1396045 - DNA, 22 bp, Artificial Sequence
  chemically synthesized
atatatgatgtaaaatgatgtt

SEQ ID NO: 1396046 - DNA, 22 bp, Artificial Sequence
  chemically synthesized
caagcaaatctaaaatataaca

SEQ ID NO: 1396047 - DNA, 22 bp, Artificial Sequence
  chemically synthesized
gtgaccgttacaagcaaatcta

SEQ ID NO: 1396048 - DNA, 22 bp, Artificial Sequence
  chemically synthesized
tattttagatttgcttgtaacg

SEQ ID NO: 1396049 - DNA, 22 bp, Artificial Sequence
  chemically synthesized
catattggtgaccgttacaagc

SEQ ID NO: 1396050 - DNA, 22 bp, Artificial Sequence
  chemically synthesized
acatattggtgaccgttacaag

SEQ ID NO: 1396051 - DNA, 22 bp, Artificial Sequence
  chemically synthesized
tttacatattggtgaccgttac

SEQ ID NO: 1396052 - DNA, 22 bp, Artificial Sequence
  chemically synthesized
tagatttgcttgtaacggtcac

SEQ ID NO: 1396053 - DNA, 22 bp, Artificial Sequence
  chemically synthesized
agatttgcttgtaacggtcacc

SEQ ID NO: 1396054 - DNA, 22 bp, Artificial Sequence
  chemically synthesized
gatttgcttgtaacggtcacca

SEQ ID NO: 1396055 - DNA, 22 bp, Artificial Sequence
  chemically synthesized
gcttgtaacggtcaccaatatg

SEQ ID NO: 1396056 - DNA, 22 bp, Artificial Sequence
  chemically synthesized
cttgtaacggtcaccaatatgt

SEQ ID NO: 1396057 - DNA, 22 bp, Artificial Sequence
  chemically synthesized
gtaacggtcaccaatatgtaaa

SEQ ID NO: 1396058 - DNA, 22 bp, Artificial Sequence
  chemically synthesized
taacggtcaccaatatgtaaac

SEQ ID NO: 1396059 - DNA, 22 bp, Artificial Sequence
  chemically synthesized
gagagagaatctgtttacatat

SEQ ID NO: 1396060 - DNA, 22 bp, Artificial Sequence
  chemically synthesized
ttggagagagaatctgtttaca

SEQ ID NO: 1396061 - DNA, 22 bp, Artificial Sequence
  chemically synthesized
attgttggagagagaatctgtt

SEQ ID NO: 1396062 - DNA, 22 bp, Artificial Sequence
  chemically synthesized
taattgttggagagagaatctg

SEQ ID NO: 1396063 - DNA, 22 bp, Artificial Sequence
  chemically synthesized
ctaattgttggagagagaatct

SEQ ID NO: 1396064 - DNA, 22 bp, Artificial Sequence
  chemically synthesized
gatttctaattgttggagagag

SEQ ID NO: 1396065 - DNA, 22 bp, Artificial Sequence
  chemically synthesized
agatttctaattgttggagaga

SEQ ID NO: 1396066 - DNA, 22 bp, Artificial Sequence
  chemically synthesized
tagtatagtttagatttctaat

SEQ ID NO: 1396067 - DNA, 22 bp, Artificial Sequence
  chemically synthesized
tctctccaacaattagaaatct

SEQ ID NO: 1396068 - DNA, 22 bp, Artificial Sequence
  chemically synthesized
gtagtatagtttagatttctaa

SEQ ID NO: 1396069 - DNA, 22 bp, Artificial Sequence
  chemically synthesized
tctccaacaattagaaatctaa

SEQ ID NO: 1396070 - DNA, 22 bp, Artificial Sequence
  chemically synthesized
tccaacaattagaaatctaaac

SEQ ID NO: 1396071 - DNA, 22 bp, Artificial Sequence
  chemically synthesized
caacaattagaaatctaaacta

SEQ ID NO: 1396072 - DNA, 22 bp, Artificial Sequence
  chemically synthesized
tagccttgtagtatagtttaga

SEQ ID NO: 1396073 - DNA, 22 bp, Artificial Sequence
  chemically synthesized
ctgtagccttgtagtatagttt

SEQ ID NO: 1396074 - DNA, 22 bp, Artificial Sequence
  chemically synthesized
gttactgtagccttgtagtata

SEQ ID NO: 1396075 - DNA, 22 bp, Artificial Sequence
  chemically synthesized
gaaatctaaactatactacaag

SEQ ID NO: 1396076 - DNA, 22 bp, Artificial Sequence
  chemically synthesized
ggttactgtagccttgtagtat

SEQ ID NO: 1396077 - DNA, 22 bp, Artificial Sequence
  chemically synthesized
tggttactgtagccttgtagta

SEQ ID NO: 1396078 - DNA, 22 bp, Artificial Sequence
  chemically synthesized
ttttggttactgtagccttgta

SEQ ID NO: 1396079 - DNA, 22 bp, Artificial Sequence
  chemically synthesized
aactatactacaaggctacagt

SEQ ID NO: 1396080 - DNA, 22 bp, Artificial Sequence
  chemically synthesized
tactacaaggctacagtaacca

SEQ ID NO: 1396081 - DNA, 22 bp, Artificial Sequence
  chemically synthesized
caaggctacagtaaccaaaaca

SEQ ID NO: 1396082 - DNA, 22 bp, Artificial Sequence
  chemically synthesized
gtaccagtaccatgctgttttg

SEQ ID NO: 1396083 - DNA, 22 bp, Artificial Sequence
  chemically synthesized
ggtaccagtaccatgctgtttt

SEQ ID NO: 1396084 - DNA, 22 bp, Artificial Sequence
  chemically synthesized
tggtaccagtaccatgctgttt

SEQ ID NO: 1396085 - DNA, 22 bp, Artificial Sequence
  chemically synthesized
cagtaaccaaaacagcatggta

SEQ ID NO: 1396086 - DNA, 22 bp, Artificial Sequence
  chemically synthesized
ttttggtaccagtaccatgctg

SEQ ID NO: 1396087 - DNA, 22 bp, Artificial Sequence
  chemically synthesized
tgttttggtaccagtaccatgc

SEQ ID NO: 1396088 - DNA, 22 bp, Artificial Sequence
  chemically synthesized
tatctctgttttggtaccagta

SEQ ID NO: 1396089 - DNA, 22 bp, Artificial Sequence
  chemically synthesized
atctgtatctctgttttggtac

SEQ ID NO: 1396090 - DNA, 22 bp, Artificial Sequence
  chemically synthesized
cattgatctgtatctctgtttt

SEQ ID NO: 1396091 - DNA, 22 bp, Artificial Sequence
  chemically synthesized
ttccattgatctgtatctctgt

SEQ ID NO: 1396092 - DNA, 22 bp, Artificial Sequence
  chemically synthesized
tgttccattgatctgtatctct

SEQ ID NO: 1396093 - DNA, 22 bp, Artificial Sequence
  chemically synthesized
gtaccaaaacagagatacagat

SEQ ID NO: 1396094 - DNA, 22 bp, Artificial Sequence
  chemically synthesized
ttctgttccattgatctgtatc

SEQ ID NO: 1396095 - DNA, 22 bp, Artificial Sequence
  chemically synthesized
tgttctgttccattgatctgta

SEQ ID NO: 1396096 - DNA, 22 bp, Artificial Sequence
  chemically synthesized
agggctctgttctgttccattg

SEQ ID NO: 1396097 - DNA, 22 bp, Artificial Sequence
  chemically synthesized
tgagggctctgttctgttccat

SEQ ID NO: 1396098 - DNA, 22 bp, Artificial Sequence
  chemically synthesized
ctgagggctctgttctgttcca

SEQ ID NO: 1396099 - DNA, 22 bp, Artificial Sequence
  chemically synthesized
tttctgagggctctgttctgtt

SEQ ID NO: 1396100 - DNA, 22 bp, Artificial Sequence
  chemically synthesized
tagatatgcagcattatttctg

SEQ ID NO: 1396101 - DNA, 22 bp, Artificial Sequence
  chemically synthesized
agaaataatgctgcatatctac

SEQ ID NO: 1396102 - DNA, 22 bp, Artificial Sequence
  chemically synthesized
tcaaagatcagatagttgtaga

SEQ ID NO: 1396103 - DNA, 22 bp, Artificial Sequence
  chemically synthesized
gtcaaagatcagatagttgtag

SEQ ID NO: 1396104 - DNA, 22 bp, Artificial Sequence
  chemically synthesized
aggtttgtcaaagatcagatag

SEQ ID NO: 1396105 - DNA, 22 bp, Artificial Sequence
  chemically synthesized
catatctacaactatctgatct

SEQ ID NO: 1396106 - DNA, 22 bp, Artificial Sequence
  chemically synthesized
tcaggtttgtcaaagatcagat

SEQ ID NO: 1396107 - DNA, 22 bp, Artificial Sequence
  chemically synthesized
ctcaggtttgtcaaagatcaga

SEQ ID NO: 1396108 - DNA, 22 bp, Artificial Sequence
  chemically synthesized
tctcaggtttgtcaaagatcag

SEQ ID NO: 1396109 - DNA, 22 bp, Artificial Sequence
  chemically synthesized
ttctcaggtttgtcaaagatca

SEQ ID NO: 1396110 - DNA, 22 bp, Artificial Sequence
  chemically synthesized
tttttctcaggtttgtcaaaga

SEQ ID NO: 1396111 - DNA, 22 bp, Artificial Sequence
  chemically synthesized
caactatctgatctttgacaaa

SEQ ID NO: 1396112 - DNA, 22 bp, Artificial Sequence
  chemically synthesized
gtttttctcaggtttgtcaaag

SEQ ID NO: 1396113 - DNA, 22 bp, Artificial Sequence
  chemically synthesized
cttgtttttctcaggtttgtca

SEQ ID NO: 1396114 - DNA, 22 bp, Artificial Sequence
  chemically synthesized
tctgatctttgacaaacctgag

SEQ ID NO: 1396115 - DNA, 22 bp, Artificial Sequence
  chemically synthesized
atctttgacaaacctgagaaaa

SEQ ID NO: 1396116 - DNA, 22 bp, Artificial Sequence
  chemically synthesized
cccattgcttgtttttctcagg

SEQ ID NO: 1396117 - DNA, 22 bp, Artificial Sequence
  chemically synthesized
ccccattgcttgtttttctcag

SEQ ID NO: 1396118 - DNA, 22 bp, Artificial Sequence
  chemically synthesized
tccccattgcttgtttttctca

SEQ ID NO: 1396119 - DNA, 22 bp, Artificial Sequence
  chemically synthesized
tgacaaacctgagaaaaacaag

SEQ ID NO: 1396120 - DNA, 22 bp, Artificial Sequence
  chemically synthesized
gacaaacctgagaaaaacaagc

SEQ ID NO: 1396121 - DNA, 22 bp, Artificial Sequence
  chemically synthesized
acaaacctgagaaaaacaagca

SEQ ID NO: 1396122 - DNA, 22 bp, Artificial Sequence
  chemically synthesized
agaaaaacaagcaatggggaaa

SEQ ID NO: 1396123 - DNA, 22 bp, Artificial Sequence
  chemically synthesized
aatagggaatcctttccccatt

SEQ ID NO: 1396124 - DNA, 22 bp, Artificial Sequence
  chemically synthesized
ttaaatagggaatcctttcccc

SEQ ID NO: 1396125 - DNA, 22 bp, Artificial Sequence
  chemically synthesized
attaaatagggaatcctttccc

SEQ ID NO: 1396126 - DNA, 22 bp, Artificial Sequence
  chemically synthesized
ccagcaccatttattaaatagg

SEQ ID NO: 1396127 - DNA, 22 bp, Artificial Sequence
  chemically synthesized
cccagcaccatttattaaatag

SEQ ID NO: 1396128 - DNA, 22 bp, Artificial Sequence
  chemically synthesized
tcccagcaccatttattaaata

SEQ ID NO: 1396129 - DNA, 22 bp, Artificial Sequence
  chemically synthesized
gccagttttcccagcaccattt

SEQ ID NO: 1396130 - DNA, 22 bp, Artificial Sequence
  chemically synthesized
cctatttaataaatggtgctgg

SEQ ID NO: 1396131 - DNA, 22 bp, Artificial Sequence
  chemically synthesized
tttaataaatggtgctgggaaa

SEQ ID NO: 1396132 - DNA, 22 bp, Artificial Sequence
  chemically synthesized
aataaatggtgctgggaaaact

SEQ ID NO: 1396133 - DNA, 22 bp, Artificial Sequence
  chemically synthesized
ataaatggtgctgggaaaactg

SEQ ID NO: 1396134 - DNA, 22 bp, Artificial Sequence
  chemically synthesized
catatggctagccagttttccc

SEQ ID NO: 1396135 - DNA, 22 bp, Artificial Sequence
  chemically synthesized
tccatatggctagccagttttc

SEQ ID NO: 1396136 - DNA, 22 bp, Artificial Sequence
  chemically synthesized
ctccatatggctagccagtttt

SEQ ID NO: 1396137 - DNA, 22 bp, Artificial Sequence
  chemically synthesized
tctccatatggctagccagttt

SEQ ID NO: 1396138 - DNA, 22 bp, Artificial Sequence
  chemically synthesized
agctttctccatatggctagcc

SEQ ID NO: 1396139 - DNA, 22 bp, Artificial Sequence
  chemically synthesized
cagctttctccatatggctagc

SEQ ID NO: 1396140 - DNA, 22 bp, Artificial Sequence
  chemically synthesized
ggaaaactggctagccatatgg

SEQ ID NO: 1396141 - DNA, 22 bp, Artificial Sequence
  chemically synthesized
gctagccatatggagaaagctg

SEQ ID NO: 1396142 - DNA, 22 bp, Artificial Sequence
  chemically synthesized
gccatatggagaaagctgaaac

SEQ ID NO: 1396143 - DNA, 22 bp, Artificial Sequence
  chemically synthesized
tataaggtgtgaggaagggatc

SEQ ID NO: 1396144 - DNA, 22 bp, Artificial Sequence
  chemically synthesized
gtataaggtgtgaggaagggat

SEQ ID NO: 1396145 - DNA, 22 bp, Artificial Sequence
  chemically synthesized
tgtataaggtgtgaggaaggga

SEQ ID NO: 1396146 - DNA, 22 bp, Artificial Sequence
  chemically synthesized
ttgtataaggtgtgaggaaggg

SEQ ID NO: 1396147 - DNA, 22 bp, Artificial Sequence
  chemically synthesized
aaactggatcccttcctcacac

SEQ ID NO: 1396148 - DNA, 22 bp, Artificial Sequence
  chemically synthesized
atttttgtataaggtgtgagga

SEQ ID NO: 1396149 - DNA, 22 bp, Artificial Sequence
  chemically synthesized
gatcccttcctcacaccttata

SEQ ID NO: 1396150 - DNA, 22 bp, Artificial Sequence
  chemically synthesized
aattaatttttgtataaggtgt

SEQ ID NO: 1396151 - DNA, 22 bp, Artificial Sequence
  chemically synthesized
gaattaatttttgtataaggtg

SEQ ID NO: 1396152 - DNA, 22 bp, Artificial Sequence
  chemically synthesized
cctcacaccttatacaaaaatt

SEQ ID NO: 1396153 - DNA, 22 bp, Artificial Sequence
  chemically synthesized
ctcacaccttatacaaaaatta

SEQ ID NO: 1396154 - DNA, 22 bp, Artificial Sequence
  chemically synthesized
atccatcttgaattaatttttg

SEQ ID NO: 1396155 - DNA, 22 bp, Artificial Sequence
  chemically synthesized
aatccatcttgaattaattttt

SEQ ID NO: 1396156 - DNA, 22 bp, Artificial Sequence
  chemically synthesized
acaccttatacaaaaattaatt

SEQ ID NO: 1396157 - DNA, 22 bp, Artificial Sequence
  chemically synthesized
taatccatcttgaattaatttt

SEQ ID NO: 1396158 - DNA, 22 bp, Artificial Sequence
  chemically synthesized
agtctttaatccatcttgaatt

SEQ ID NO: 1396159 - DNA, 22 bp, Artificial Sequence
  chemically synthesized
atacaaaaattaattcaagatg

SEQ ID NO: 1396160 - DNA, 22 bp, Artificial Sequence
  chemically synthesized
aagtctttaatccatcttgaat

SEQ ID NO: 1396161 - DNA, 22 bp, Artificial Sequence
  chemically synthesized
tacaaaaattaattcaagatgg

SEQ ID NO: 1396162 - DNA, 22 bp, Artificial Sequence
  chemically synthesized
acgtttaagtctttaatccatc

SEQ ID NO: 1396163 - DNA, 22 bp, Artificial Sequence
  chemically synthesized
attcaagatggattaaagactt

SEQ ID NO: 1396164 - DNA, 22 bp, Artificial Sequence
  chemically synthesized
ggtctaacgtttaagtctttaa

SEQ ID NO: 1396165 - DNA, 22 bp, Artificial Sequence
  chemically synthesized
aggtctaacgtttaagtcttta

SEQ ID NO: 1396166 - DNA, 22 bp, Artificial Sequence
  chemically synthesized
taggtctaacgtttaagtcttt

SEQ ID NO: 1396167 - DNA, 22 bp, Artificial Sequence
  chemically synthesized
aagatggattaaagacttaaac

SEQ ID NO: 1396168 - DNA, 22 bp, Artificial Sequence
  chemically synthesized
tggttttaggtctaacgtttaa

SEQ ID NO: 1396169 - DNA, 22 bp, Artificial Sequence
  chemically synthesized
atggttttaggtctaacgttta

SEQ ID NO: 1396170 - DNA, 22 bp, Artificial Sequence
  chemically synthesized
tatggttttaggtctaacgttt

SEQ ID NO: 1396171 - DNA, 22 bp, Artificial Sequence
  chemically synthesized
ttatggttttaggtctaacgtt

SEQ ID NO: 1396172 - DNA, 22 bp, Artificial Sequence
  chemically synthesized
aagacttaaacgttagacctaa

SEQ ID NO: 1396173 - DNA, 22 bp, Artificial Sequence
  chemically synthesized
gggtttttatggttttaggtct

SEQ ID NO: 1396174 - DNA, 22 bp, Artificial Sequence
  chemically synthesized
tagggtttttatggttttaggt

SEQ ID NO: 1396175 - DNA, 22 bp, Artificial Sequence
  chemically synthesized
ctagggtttttatggttttagg

SEQ ID NO: 1396176 - DNA, 22 bp, Artificial Sequence
  chemically synthesized
aaacgttagacctaaaaccata

SEQ ID NO: 1396177 - DNA, 22 bp, Artificial Sequence
  chemically synthesized
ttctagggtttttatggtttta

SEQ ID NO: 1396178 - DNA, 22 bp, Artificial Sequence
  chemically synthesized
aacgttagacctaaaaccataa

SEQ ID NO: 1396179 - DNA, 22 bp, Artificial Sequence
  chemically synthesized
cttctagggtttttatggtttt

SEQ ID NO: 1396180 - DNA, 22 bp, Artificial Sequence
  chemically synthesized
tcttctagggtttttatggttt

SEQ ID NO: 1396181 - DNA, 22 bp, Artificial Sequence
  chemically synthesized
ggttttcttctagggtttttat

SEQ ID NO: 1396182 - DNA, 22 bp, Artificial Sequence
  chemically synthesized
gacctaaaaccataaaaaccct

SEQ ID NO: 1396183 - DNA, 22 bp, Artificial Sequence
  chemically synthesized
aaaccataaaaaccctagaaga

SEQ ID NO: 1396184 - DNA, 22 bp, Artificial Sequence
  chemically synthesized
aatggtaatgcctaggttttct

SEQ ID NO: 1396185 - DNA, 22 bp, Artificial Sequence
  chemically synthesized
tgtcctgaatggtaatgcctag

SEQ ID NO: 1396186 - DNA, 22 bp, Artificial Sequence
  chemically synthesized
gaagaaaacctaggcattacca

SEQ ID NO: 1396187 - DNA, 22 bp, Artificial Sequence
  chemically synthesized
tgcctatgtcctgaatggtaat

SEQ ID NO: 1396188 - DNA, 22 bp, Artificial Sequence
  chemically synthesized
cctatgcctatgtcctgaatgg

SEQ ID NO: 1396189 - DNA, 22 bp, Artificial Sequence
  chemically synthesized
gcctatgcctatgtcctgaatg

SEQ ID NO: 1396190 - DNA, 22 bp, Artificial Sequence
  chemically synthesized
ggcattaccattcaggacatag

SEQ ID NO: 1396191 - DNA, 22 bp, Artificial Sequence
  chemically synthesized
ccattcaggacataggcatagg

SEQ ID NO: 1396192 - DNA, 22 bp, Artificial Sequence
  chemically synthesized
gacatgaagtccttgcctatgc

SEQ ID NO: 1396193 - DNA, 22 bp, Artificial Sequence
  chemically synthesized
agacatgaagtccttgcctatg

SEQ ID NO: 1396194 - DNA, 22 bp, Artificial Sequence
  chemically synthesized
tagacatgaagtccttgcctat

SEQ ID NO: 1396195 - DNA, 22 bp, Artificial Sequence
  chemically synthesized
aggacataggcataggcaagga

SEQ ID NO: 1396196 - DNA, 22 bp, Artificial Sequence
  chemically synthesized
gtgttttagacatgaagtcctt

SEQ ID NO: 1396197 - DNA, 22 bp, Artificial Sequence
  chemically synthesized
ggtgttttagacatgaagtcct

SEQ ID NO: 1396198 - DNA, 22 bp, Artificial Sequence
  chemically synthesized
tggtgttttagacatgaagtcc

SEQ ID NO: 1396199 - DNA, 22 bp, Artificial Sequence
  chemically synthesized
ttggtgttttagacatgaagtc

SEQ ID NO: 1396200 - DNA, 22 bp, Artificial Sequence
  chemically synthesized
cttttggtgttttagacatgaa

SEQ ID NO: 1396201 - DNA, 22 bp, Artificial Sequence
  chemically synthesized
ccattgcttttggtgttttaga

SEQ ID NO: 1396202 - DNA, 22 bp, Artificial Sequence
  chemically synthesized
ttgccattgcttttggtgtttt

SEQ ID NO: 1396203 - DNA, 22 bp, Artificial Sequence
  chemically synthesized
gttgccattgcttttggtgttt

SEQ ID NO: 1396204 - DNA, 22 bp, Artificial Sequence
  chemically synthesized
tgttgccattgcttttggtgtt

SEQ ID NO: 1396205 - DNA, 22 bp, Artificial Sequence
  chemically synthesized
ttgttgccattgcttttggtgt

SEQ ID NO: 1396206 - DNA, 22 bp, Artificial Sequence
  chemically synthesized
catgtctaaaacaccaaaagca

SEQ ID NO: 1396207 - DNA, 22 bp, Artificial Sequence
  chemically synthesized
atgtctaaaacaccaaaagcaa

SEQ ID NO: 1396208 - DNA, 22 bp, Artificial Sequence
  chemically synthesized
gcttttgttgccattgcttttg

SEQ ID NO: 1396209 - DNA, 22 bp, Artificial Sequence
  chemically synthesized
ggcttttgttgccattgctttt

SEQ ID NO: 1396210 - DNA, 22 bp, Artificial Sequence
  chemically synthesized
tggcttttgttgccattgcttt

SEQ ID NO: 1396211 - DNA, 22 bp, Artificial Sequence
  chemically synthesized
aaacaccaaaagcaatggcaac

SEQ ID NO: 1396212 - DNA, 22 bp, Artificial Sequence
  chemically synthesized
tcaattttggcttttgttgcca

SEQ ID NO: 1396213 - DNA, 22 bp, Artificial Sequence
  chemically synthesized
gtcaattttggcttttgttgcc

SEQ ID NO: 1396214 - DNA, 22 bp, Artificial Sequence
  chemically synthesized
atgagatcccatttgtcaattt

SEQ ID NO: 1396215 - DNA, 22 bp, Artificial Sequence
  chemically synthesized
gatgagatcccatttgtcaatt

SEQ ID NO: 1396216 - DNA, 22 bp, Artificial Sequence
  chemically synthesized
gtttgatgagatcccatttgtc

SEQ ID NO: 1396217 - DNA, 22 bp, Artificial Sequence
  chemically synthesized
agtttgatgagatcccatttgt

SEQ ID NO: 1396218 - DNA, 22 bp, Artificial Sequence
  chemically synthesized
tagtttgatgagatcccatttg

SEQ ID NO: 1396219 - DNA, 22 bp, Artificial Sequence
  chemically synthesized
tttagtttgatgagatcccatt

SEQ ID NO: 1396220 - DNA, 22 bp, Artificial Sequence
  chemically synthesized
acaaatgggatctcatcaaact

SEQ ID NO: 1396221 - DNA, 22 bp, Artificial Sequence
  chemically synthesized
tgcagaagctctttagtttgat

SEQ ID NO: 1396222 - DNA, 22 bp, Artificial Sequence
  chemically synthesized
ctgtgcagaagctctttagttt

SEQ ID NO: 1396223 - DNA, 22 bp, Artificial Sequence
  chemically synthesized
gctgtgcagaagctctttagtt

SEQ ID NO: 1396224 - DNA, 22 bp, Artificial Sequence
  chemically synthesized
tgctgtgcagaagctctttagt

SEQ ID NO: 1396225 - DNA, 22 bp, Artificial Sequence
  chemically synthesized
ttgctgtgcagaagctctttag

SEQ ID NO: 1396226 - DNA, 22 bp, Artificial Sequence
  chemically synthesized
ttttgctgtgcagaagctcttt

SEQ ID NO: 1396227 - DNA, 22 bp, Artificial Sequence
  chemically synthesized
cttttgctgtgcagaagctctt

SEQ ID NO: 1396228 - DNA, 22 bp, Artificial Sequence
  chemically synthesized
atcaaactaaagagcttctgca

SEQ ID NO: 1396229 - DNA, 22 bp, Artificial Sequence
  chemically synthesized
atggtagtttcttttgctgtgc

SEQ ID NO: 1396230 - DNA, 22 bp, Artificial Sequence
  chemically synthesized
aagagcttctgcacagcaaaag

SEQ ID NO: 1396231 - DNA, 22 bp, Artificial Sequence
  chemically synthesized
tgatggtagtttcttttgctgt

SEQ ID NO: 1396232 - DNA, 22 bp, Artificial Sequence
  chemically synthesized
actctgatggtagtttcttttg

SEQ ID NO: 1396233 - DNA, 22 bp, Artificial Sequence
  chemically synthesized
ttcactctgatggtagtttctt

SEQ ID NO: 1396234 - DNA, 22 bp, Artificial Sequence
  chemically synthesized
ctgcacagcaaaagaaactacc

SEQ ID NO: 1396235 - DNA, 22 bp, Artificial Sequence
  chemically synthesized
tgcacagcaaaagaaactacca

SEQ ID NO: 1396236 - DNA, 22 bp, Artificial Sequence
  chemically synthesized
cacagcaaaagaaactaccatc

SEQ ID NO: 1396237 - DNA, 22 bp, Artificial Sequence
  chemically synthesized
cctgttcactctgatggtagtt

SEQ ID NO: 1396238 - DNA, 22 bp, Artificial Sequence
  chemically synthesized
taggttgcctgttcactctgat

SEQ ID NO: 1396239 - DNA, 22 bp, Artificial Sequence
  chemically synthesized
gtaggttgcctgttcactctga

SEQ ID NO: 1396240 - DNA, 22 bp, Artificial Sequence
  chemically synthesized
tgtaggttgcctgttcactctg

SEQ ID NO: 1396241 - DNA, 22 bp, Artificial Sequence
  chemically synthesized
ccattttgtaggttgcctgttc

SEQ ID NO: 1396242 - DNA, 22 bp, Artificial Sequence
  chemically synthesized
ccatcagagtgaacaggcaacc

SEQ ID NO: 1396243 - DNA, 22 bp, Artificial Sequence
  chemically synthesized
tcccattttgtaggttgcctgt

SEQ ID NO: 1396244 - DNA, 22 bp, Artificial Sequence
  chemically synthesized
ctcccattttgtaggttgcctg

SEQ ID NO: 1396245 - DNA, 22 bp, Artificial Sequence
  chemically synthesized
tctcccattttgtaggttgcct

SEQ ID NO: 1396246 - DNA, 22 bp, Artificial Sequence
  chemically synthesized
cgaaaattttctcccattttgt

SEQ ID NO: 1396247 - DNA, 22 bp, Artificial Sequence
  chemically synthesized
caaaatgggagaaaattttcgc

SEQ ID NO: 1396248 - DNA, 22 bp, Artificial Sequence
  chemically synthesized
tcagatgagtaggttgcgaaaa

SEQ ID NO: 1396249 - DNA, 22 bp, Artificial Sequence
  chemically synthesized
gtcagatgagtaggttgcgaaa

SEQ ID NO: 1396250 - DNA, 22 bp, Artificial Sequence
  chemically synthesized
tgtcagatgagtaggttgcgaa

SEQ ID NO: 1396251 - DNA, 22 bp, Artificial Sequence
  chemically synthesized
gccctttgtcagatgagtaggt

SEQ ID NO: 1396252 - DNA, 22 bp, Artificial Sequence
  chemically synthesized
tcgcaacctactcatctgacaa

SEQ ID NO: 1396253 - DNA, 22 bp, Artificial Sequence
  chemically synthesized
gatattagccctttgtcagatg

SEQ ID NO: 1396254 - DNA, 22 bp, Artificial Sequence
  chemically synthesized
cgcaacctactcatctgacaaa

SEQ ID NO: 1396255 - DNA, 22 bp, Artificial Sequence
  chemically synthesized
gcaacctactcatctgacaaag

SEQ ID NO: 1396256 - DNA, 22 bp, Artificial Sequence
  chemically synthesized
tggatattagccctttgtcaga

SEQ ID NO: 1396257 - DNA, 22 bp, Artificial Sequence
  chemically synthesized
tagattctggatattagccctt

SEQ ID NO: 1396258 - DNA, 22 bp, Artificial Sequence
  chemically synthesized
ctcatctgacaaagggctaata

SEQ ID NO: 1396259 - DNA, 22 bp, Artificial Sequence
  chemically synthesized
atctgacaaagggctaatatcc

SEQ ID NO: 1396260 - DNA, 22 bp, Artificial Sequence
  chemically synthesized
attgtagattctggatattagc

SEQ ID NO: 1396261 - DNA, 22 bp, Artificial Sequence
  chemically synthesized
acaaagggctaatatccagaat

SEQ ID NO: 1396262 - DNA, 22 bp, Artificial Sequence
  chemically synthesized
agttcattgtagattctggata

SEQ ID NO: 1396263 - DNA, 22 bp, Artificial Sequence
  chemically synthesized
gagttcattgtagattctggat

SEQ ID NO: 1396264 - DNA, 22 bp, Artificial Sequence
  chemically synthesized
tttgagttcattgtagattctg

SEQ ID NO: 1396265 - DNA, 22 bp, Artificial Sequence
  chemically synthesized
gtttgagttcattgtagattct

SEQ ID NO: 1396266 - DNA, 22 bp, Artificial Sequence
  chemically synthesized
atatccagaatctacaatgaac

SEQ ID NO: 1396267 - DNA, 22 bp, Artificial Sequence
  chemically synthesized
taaatttgtttgagttcattgt

SEQ ID NO: 1396268 - DNA, 22 bp, Artificial Sequence
  chemically synthesized
gtaaatttgtttgagttcattg

SEQ ID NO: 1396269 - DNA, 22 bp, Artificial Sequence
  chemically synthesized
ttgtaaatttgtttgagttcat

SEQ ID NO: 1396270 - DNA, 22 bp, Artificial Sequence
  chemically synthesized
cttgtaaatttgtttgagttca

SEQ ID NO: 1396271 - DNA, 22 bp, Artificial Sequence
  chemically synthesized
tcttgtaaatttgtttgagttc

SEQ ID NO: 1396272 - DNA, 22 bp, Artificial Sequence
  chemically synthesized
ttcttgtaaatttgtttgagtt

SEQ ID NO: 1396273 - DNA, 22 bp, Artificial Sequence
  chemically synthesized
tttcttgtaaatttgtttgagt

SEQ ID NO: 1396274 - DNA, 22 bp, Artificial Sequence
  chemically synthesized
ttttcttgtaaatttgtttgag

SEQ ID NO: 1396275 - DNA, 22 bp, Artificial Sequence
  chemically synthesized
tttttttcttgtaaatttgttt

SEQ ID NO: 1396276 - DNA, 22 bp, Artificial Sequence
  chemically synthesized
gtttttttcttgtaaatttgtt

SEQ ID NO: 1396277 - DNA, 22 bp, Artificial Sequence
  chemically synthesized
caatgaactcaaacaaatttac

SEQ ID NO: 1396278 - DNA, 22 bp, Artificial Sequence
  chemically synthesized
tttgtttttttcttgtaaattt

SEQ ID NO: 1396279 - DNA, 22 bp, Artificial Sequence
  chemically synthesized
aaacaaatttacaagaaaaaaa

SEQ ID NO: 1396280 - DNA, 22 bp, Artificial Sequence
  chemically synthesized
atggggttgtttgtttttttct

SEQ ID NO: 1396281 - DNA, 22 bp, Artificial Sequence
  chemically synthesized
gatggggttgtttgtttttttc

SEQ ID NO: 1396282 - DNA, 22 bp, Artificial Sequence
  chemically synthesized
tgatggggttgtttgttttttt

SEQ ID NO: 1396283 - DNA, 22 bp, Artificial Sequence
  chemically synthesized
ttgatggggttgtttgtttttt

SEQ ID NO: 1396284 - DNA, 22 bp, Artificial Sequence
  chemically synthesized
tttgatggggttgtttgttttt

SEQ ID NO: 1396285 - DNA, 22 bp, Artificial Sequence
  chemically synthesized
acaagaaaaaaacaaacaaccc

SEQ ID NO: 1396286 - DNA, 22 bp, Artificial Sequence
  chemically synthesized
caagaaaaaaacaaacaacccc

SEQ ID NO: 1396287 - DNA, 22 bp, Artificial Sequence
  chemically synthesized
gcccactttttgatggggttgt

SEQ ID NO: 1396288 - DNA, 22 bp, Artificial Sequence
  chemically synthesized
cgcccactttttgatggggttg

SEQ ID NO: 1396289 - DNA, 22 bp, Artificial Sequence
  chemically synthesized
atgtccttcgcccactttttga

SEQ ID NO: 1396290 - DNA, 22 bp, Artificial Sequence
  chemically synthesized
ttcatgtccttcgcccactttt

SEQ ID NO: 1396291 - DNA, 22 bp, Artificial Sequence
  chemically synthesized
agaagtgtctgttcatgtcctt

SEQ ID NO: 1396292 - DNA, 22 bp, Artificial Sequence
  chemically synthesized
gagaagtgtctgttcatgtcct

SEQ ID NO: 1396293 - DNA, 22 bp, Artificial Sequence
  chemically synthesized
tgagaagtgtctgttcatgtcc

SEQ ID NO: 1396294 - DNA, 22 bp, Artificial Sequence
  chemically synthesized
ttgagaagtgtctgttcatgtc

SEQ ID NO: 1396295 - DNA, 22 bp, Artificial Sequence
  chemically synthesized
ttttgagaagtgtctgttcatg

SEQ ID NO: 1396296 - DNA, 22 bp, Artificial Sequence
  chemically synthesized
cttttgagaagtgtctgttcat

SEQ ID NO: 1396297 - DNA, 22 bp, Artificial Sequence
  chemically synthesized
cataaatgtcttcttttgagaa

SEQ ID NO: 1396298 - DNA, 22 bp, Artificial Sequence
  chemically synthesized
gctgcataaatgtcttcttttg

SEQ ID NO: 1396299 - DNA, 22 bp, Artificial Sequence
  chemically synthesized
ggctgcataaatgtcttctttt

SEQ ID NO: 1396300 - DNA, 22 bp, Artificial Sequence
  chemically synthesized
tggctgcataaatgtcttcttt

SEQ ID NO: 1396301 - DNA, 22 bp, Artificial Sequence
  chemically synthesized
ttggctgcataaatgtcttctt

SEQ ID NO: 1396302 - DNA, 22 bp, Artificial Sequence
  chemically synthesized
ctcaaaagaagacatttatgca

SEQ ID NO: 1396303 - DNA, 22 bp, Artificial Sequence
  chemically synthesized
tcaaaagaagacatttatgcag

SEQ ID NO: 1396304 - DNA, 22 bp, Artificial Sequence
  chemically synthesized
atgtgtcttttggctgcataaa

SEQ ID NO: 1396305 - DNA, 22 bp, Artificial Sequence
  chemically synthesized
aaaagaagacatttatgcagcc

SEQ ID NO: 1396306 - DNA, 22 bp, Artificial Sequence
  chemically synthesized
catgtgtcttttggctgcataa

SEQ ID NO: 1396307 - DNA, 22 bp, Artificial Sequence
  chemically synthesized
tcatgtgtcttttggctgcata

SEQ ID NO: 1396308 - DNA, 22 bp, Artificial Sequence
  chemically synthesized
ttcatgtgtcttttggctgcat

SEQ ID NO: 1396309 - DNA, 22 bp, Artificial Sequence
  chemically synthesized
tttcatgtgtcttttggctgca

SEQ ID NO: 1396310 - DNA, 22 bp, Artificial Sequence
  chemically synthesized
atgcagccaaaagacacatgaa

SEQ ID NO: 1396311 - DNA, 22 bp, Artificial Sequence
  chemically synthesized
tgcagccaaaagacacatgaaa

SEQ ID NO: 1396312 - DNA, 22 bp, Artificial Sequence
  chemically synthesized
atggccagtgatgatgagcatt

SEQ ID NO: 1396313 - DNA, 22 bp, Artificial Sequence
  chemically synthesized
tgatggccagtgatgatgagca

SEQ ID NO: 1396314 - DNA, 22 bp, Artificial Sequence
  chemically synthesized
tctgatggccagtgatgatgag

SEQ ID NO: 1396315 - DNA, 22 bp, Artificial Sequence
  chemically synthesized
ctctgatggccagtgatgatga

SEQ ID NO: 1396316 - DNA, 22 bp, Artificial Sequence
  chemically synthesized
catttctctgatggccagtgat

SEQ ID NO: 1396317 - DNA, 22 bp, Artificial Sequence
  chemically synthesized
gcatttctctgatggccagtga

SEQ ID NO: 1396318 - DNA, 22 bp, Artificial Sequence
  chemically synthesized
atttgcatttctctgatggcca

SEQ ID NO: 1396319 - DNA, 22 bp, Artificial Sequence
  chemically synthesized
gatttgcatttctctgatggcc

SEQ ID NO: 1396320 - DNA, 22 bp, Artificial Sequence
  chemically synthesized
tgatttgcatttctctgatggc

SEQ ID NO: 1396321 - DNA, 22 bp, Artificial Sequence
  chemically synthesized
atcatcactggccatcagagaa

SEQ ID NO: 1396322 - DNA, 22 bp, Artificial Sequence
  chemically synthesized
tggttttgatttgcatttctct

SEQ ID NO: 1396323 - DNA, 22 bp, Artificial Sequence
  chemically synthesized
attgtggttttgatttgcattt

SEQ ID NO: 1396324 - DNA, 22 bp, Artificial Sequence
  chemically synthesized
gccatcagagaaatgcaaatca

SEQ ID NO: 1396325 - DNA, 22 bp, Artificial Sequence
  chemically synthesized
gtgtgagatggtatctcattgt

SEQ ID NO: 1396326 - DNA, 22 bp, Artificial Sequence
  chemically synthesized
actggtgtgagatggtatctca

SEQ ID NO: 1396327 - DNA, 22 bp, Artificial Sequence
  chemically synthesized
taactggtgtgagatggtatct

SEQ ID NO: 1396328 - DNA, 22 bp, Artificial Sequence
  chemically synthesized
atgatcgccattctaactggtg

SEQ ID NO: 1396329 - DNA, 22 bp, Artificial Sequence
  chemically synthesized
aatgatcgccattctaactggt

SEQ ID NO: 1396330 - DNA, 22 bp, Artificial Sequence
  chemically synthesized
taatgatcgccattctaactgg

SEQ ID NO: 1396331 - DNA, 22 bp, Artificial Sequence
  chemically synthesized
ttaatgatcgccattctaactg

SEQ ID NO: 1396332 - DNA, 22 bp, Artificial Sequence
  chemically synthesized
tttaatgatcgccattctaact

SEQ ID NO: 1396333 - DNA, 22 bp, Artificial Sequence
  chemically synthesized
actttttaatgatcgccattct

SEQ ID NO: 1396334 - DNA, 22 bp, Artificial Sequence
  chemically synthesized
acaccagttagaatggcgatca

SEQ ID NO: 1396335 - DNA, 22 bp, Artificial Sequence
  chemically synthesized
ctgactttttaatgatcgccat

SEQ ID NO: 1396336 - DNA, 22 bp, Artificial Sequence
  chemically synthesized
cctgactttttaatgatcgcca

SEQ ID NO: 1396337 - DNA, 22 bp, Artificial Sequence
  chemically synthesized
tttcctgactttttaatgatcg

SEQ ID NO: 1396338 - DNA, 22 bp, Artificial Sequence
  chemically synthesized
ttgtttcctgactttttaatga

SEQ ID NO: 1396339 - DNA, 22 bp, Artificial Sequence
  chemically synthesized
gaatggcgatcattaaaaagtc

SEQ ID NO: 1396340 - DNA, 22 bp, Artificial Sequence
  chemically synthesized
cagcacctgttgtttcctgact

SEQ ID NO: 1396341 - DNA, 22 bp, Artificial Sequence
  chemically synthesized
tccagcacctgttgtttcctga

SEQ ID NO: 1396342 - DNA, 22 bp, Artificial Sequence
  chemically synthesized
aaaagtcaggaaacaacaggtg

SEQ ID NO: 1396343 - DNA, 22 bp, Artificial Sequence
  chemically synthesized
cacatcctctccagcacctgtt

SEQ ID NO: 1396344 - DNA, 22 bp, Artificial Sequence
  chemically synthesized
tccacatcctctccagcacctg

SEQ ID NO: 1396345 - DNA, 22 bp, Artificial Sequence
  chemically synthesized
ctccacatcctctccagcacct

SEQ ID NO: 1396346 - DNA, 22 bp, Artificial Sequence
  chemically synthesized
tttctccacatcctctccagca

SEQ ID NO: 1396347 - DNA, 22 bp, Artificial Sequence
  chemically synthesized
ctatttctccacatcctctcca

SEQ ID NO: 1396348 - DNA, 22 bp, Artificial Sequence
  chemically synthesized
gagaggatgtggagaaatagga

SEQ ID NO: 1396349 - DNA, 22 bp, Artificial Sequence
  chemically synthesized
cagtcccgccaacagtgtaaaa

SEQ ID NO: 1396350 - DNA, 22 bp, Artificial Sequence
  chemically synthesized
acagtcccgccaacagtgtaaa

SEQ ID NO: 1396351 - DNA, 22 bp, Artificial Sequence
  chemically synthesized
gtttacagtcccgccaacagtg

SEQ ID NO: 1396352 - DNA, 22 bp, Artificial Sequence
  chemically synthesized
aactagtttacagtcccgccaa

SEQ ID NO: 1396353 - DNA, 22 bp, Artificial Sequence
  chemically synthesized
ttacactgttggcgggactgta

SEQ ID NO: 1396354 - DNA, 22 bp, Artificial Sequence
  chemically synthesized
tacactgttggcgggactgtaa

SEQ ID NO: 1396355 - DNA, 22 bp, Artificial Sequence
  chemically synthesized
acactgttggcgggactgtaaa

SEQ ID NO: 1396356 - DNA, 22 bp, Artificial Sequence
  chemically synthesized
cactgttggcgggactgtaaac

SEQ ID NO: 1396357 - DNA, 22 bp, Artificial Sequence
  chemically synthesized
cacaatggttgaactagtttac

SEQ ID NO: 1396358 - DNA, 22 bp, Artificial Sequence
  chemically synthesized
ttggcgggactgtaaactagtt

SEQ ID NO: 1396359 - DNA, 22 bp, Artificial Sequence
  chemically synthesized
ccacaatggttgaactagttta

SEQ ID NO: 1396360 - DNA, 22 bp, Artificial Sequence
  chemically synthesized
gcgggactgtaaactagttcaa

SEQ ID NO: 1396361 - DNA, 22 bp, Artificial Sequence
  chemically synthesized
acttccacaatggttgaactag

SEQ ID NO: 1396362 - DNA, 22 bp, Artificial Sequence
  chemically synthesized
taaactagttcaaccattgtgg

SEQ ID NO: 1396363 - DNA, 22 bp, Artificial Sequence
  chemically synthesized
gttcaaccattgtggaagtcag

SEQ ID NO: 1396364 - DNA, 22 bp, Artificial Sequence
  chemically synthesized
aggaatcgccacactgacttcc

SEQ ID NO: 1396365 - DNA, 22 bp, Artificial Sequence
  chemically synthesized
aaccattgtggaagtcagtgtg

SEQ ID NO: 1396366 - DNA, 22 bp, Artificial Sequence
  chemically synthesized
gatccctgaggaatcgccacac

SEQ ID NO: 1396367 - DNA, 22 bp, Artificial Sequence
  chemically synthesized
tagatccctgaggaatcgccac

SEQ ID NO: 1396368 - DNA, 22 bp, Artificial Sequence
  chemically synthesized
tggaagtcagtgtggcgattcc

SEQ ID NO: 1396369 - DNA, 22 bp, Artificial Sequence
  chemically synthesized
gttctagatccctgaggaatcg

SEQ ID NO: 1396370 - DNA, 22 bp, Artificial Sequence
  chemically synthesized
tagttctagatccctgaggaat

SEQ ID NO: 1396371 - DNA, 22 bp, Artificial Sequence
  chemically synthesized
ctagttctagatccctgaggaa

SEQ ID NO: 1396372 - DNA, 22 bp, Artificial Sequence
  chemically synthesized
ctcagggatctagaactagaaa

SEQ ID NO: 1396373 - DNA, 22 bp, Artificial Sequence
  chemically synthesized
tgtcaaatggtatttctagttc

SEQ ID NO: 1396374 - DNA, 22 bp, Artificial Sequence
  chemically synthesized
agggatctagaactagaaatac

SEQ ID NO: 1396375 - DNA, 22 bp, Artificial Sequence
  chemically synthesized
gaactagaaataccatttgaca

SEQ ID NO: 1396376 - DNA, 22 bp, Artificial Sequence
  chemically synthesized
gaaataccatttgacacagcca

SEQ ID NO: 1396377 - DNA, 22 bp, Artificial Sequence
  chemically synthesized
ggtatatacccagtaatgggat

SEQ ID NO: 1396378 - DNA, 22 bp, Artificial Sequence
  chemically synthesized
gggtatatacccagtaatggga

SEQ ID NO: 1396379 - DNA, 22 bp, Artificial Sequence
  chemically synthesized
tgggtatatacccagtaatggg

SEQ ID NO: 1396380 - DNA, 22 bp, Artificial Sequence
  chemically synthesized
gacacagccatcccattactgg

SEQ ID NO: 1396381 - DNA, 22 bp, Artificial Sequence
  chemically synthesized
acacagccatcccattactggg

SEQ ID NO: 1396382 - DNA, 22 bp, Artificial Sequence
  chemically synthesized
tagtcctttgggtatataccca

SEQ ID NO: 1396383 - DNA, 22 bp, Artificial Sequence
  chemically synthesized
atagtcctttgggtatataccc

SEQ ID NO: 1396384 - DNA, 22 bp, Artificial Sequence
  chemically synthesized
ctgggtatatacccaaaggact

SEQ ID NO: 1396385 - DNA, 22 bp, Artificial Sequence
  chemically synthesized
ggtatatacccaaaggactata

SEQ ID NO: 1396386 - DNA, 22 bp, Artificial Sequence
  chemically synthesized
tagcagcatgatttatagtcct

SEQ ID NO: 1396387 - DNA, 22 bp, Artificial Sequence
  chemically synthesized
atagcagcatgatttatagtcc

SEQ ID NO: 1396388 - DNA, 22 bp, Artificial Sequence
  chemically synthesized
tatagcagcatgatttatagtc

SEQ ID NO: 1396389 - DNA, 22 bp, Artificial Sequence
  chemically synthesized
taaatcatgctgctataaagac

SEQ ID NO: 1396390 - DNA, 22 bp, Artificial Sequence
  chemically synthesized
ctataaagacacatgcacacgt

SEQ ID NO: 1396391 - DNA, 22 bp, Artificial Sequence
  chemically synthesized
taaagacacatgcacacgtatg

SEQ ID NO: 1396392 - DNA, 22 bp, Artificial Sequence
  chemically synthesized
tgaatagtgccgcaatgaacat

SEQ ID NO: 1396393 - DNA, 22 bp, Artificial Sequence
  chemically synthesized
ttgtgaatagtgccgcaatgaa

SEQ ID NO: 1396394 - DNA, 22 bp, Artificial Sequence
  chemically synthesized
ctattgtgaatagtgccgcaat

SEQ ID NO: 1396395 - DNA, 22 bp, Artificial Sequence
  chemically synthesized
gctattgtgaatagtgccgcaa

SEQ ID NO: 1396396 - DNA, 22 bp, Artificial Sequence
  chemically synthesized
tgctattgtgaatagtgccgca

SEQ ID NO: 1396397 - DNA, 22 bp, Artificial Sequence
  chemically synthesized
caagtctttgctattgtgaata

SEQ ID NO: 1396398 - DNA, 22 bp, Artificial Sequence
  chemically synthesized
attgcggcactattcacaatag

SEQ ID NO: 1396399 - DNA, 22 bp, Artificial Sequence
  chemically synthesized
gttccaagtctttgctattgtg

SEQ ID NO: 1396400 - DNA, 22 bp, Artificial Sequence
  chemically synthesized
cggcactattcacaatagcaaa

SEQ ID NO: 1396401 - DNA, 22 bp, Artificial Sequence
  chemically synthesized
ggttggttccaagtctttgcta

SEQ ID NO: 1396402 - DNA, 22 bp, Artificial Sequence
  chemically synthesized
gggttggttccaagtctttgct

SEQ ID NO: 1396403 - DNA, 22 bp, Artificial Sequence
  chemically synthesized
ttcacaatagcaaagacttgga

SEQ ID NO: 1396404 - DNA, 22 bp, Artificial Sequence
  chemically synthesized
acaatagcaaagacttggaacc

SEQ ID NO: 1396405 - DNA, 22 bp, Artificial Sequence
  chemically synthesized
gacatttgggttggttccaagt

SEQ ID NO: 1396406 - DNA, 22 bp, Artificial Sequence
  chemically synthesized
ttggacatttgggttggttcca

SEQ ID NO: 1396407 - DNA, 22 bp, Artificial Sequence
  chemically synthesized
tcattgttggacatttgggttg

SEQ ID NO: 1396408 - DNA, 22 bp, Artificial Sequence
  chemically synthesized
ggaaccaacccaaatgtccaac

SEQ ID NO: 1396409 - DNA, 22 bp, Artificial Sequence
  chemically synthesized
gaaccaacccaaatgtccaaca

SEQ ID NO: 1396410 - DNA, 22 bp, Artificial Sequence
  chemically synthesized
atccagtctatcattgttggac

SEQ ID NO: 1396411 - DNA, 22 bp, Artificial Sequence
  chemically synthesized
aatccagtctatcattgttgga

SEQ ID NO: 1396412 - DNA, 22 bp, Artificial Sequence
  chemically synthesized
ttaatccagtctatcattgttg

SEQ ID NO: 1396413 - DNA, 22 bp, Artificial Sequence
  chemically synthesized
cttaatccagtctatcattgtt

SEQ ID NO: 1396414 - DNA, 22 bp, Artificial Sequence
  chemically synthesized
tcttaatccagtctatcattgt

SEQ ID NO: 1396415 - DNA, 22 bp, Artificial Sequence
  chemically synthesized
catggtgtatatgtgccacatt

SEQ ID NO: 1396416 - DNA, 22 bp, Artificial Sequence
  chemically synthesized
gattaagaaaatgtggcacata

SEQ ID NO: 1396417 - DNA, 22 bp, Artificial Sequence
  chemically synthesized
agaaaatgtggcacatatacac

SEQ ID NO: 1396418 - DNA, 22 bp, Artificial Sequence
  chemically synthesized
catagtattccatggtgtatat

SEQ ID NO: 1396419 - DNA, 22 bp, Artificial Sequence
  chemically synthesized
tggctgcatagtattccatggt

SEQ ID NO: 1396420 - DNA, 22 bp, Artificial Sequence
  chemically synthesized
atggctgcatagtattccatgg

SEQ ID NO: 1396421 - DNA, 22 bp, Artificial Sequence
  chemically synthesized
tatggctgcatagtattccatg

SEQ ID NO: 1396422 - DNA, 22 bp, Artificial Sequence
  chemically synthesized
ttatggctgcatagtattccat

SEQ ID NO: 1396423 - DNA, 22 bp, Artificial Sequence
  chemically synthesized
tttatggctgcatagtattcca

SEQ ID NO: 1396424 - DNA, 22 bp, Artificial Sequence
  chemically synthesized
atcattttttatggctgcatag

SEQ ID NO: 1396425 - DNA, 22 bp, Artificial Sequence
  chemically synthesized
tgcagccataaaaaatgatgag

SEQ ID NO: 1396426 - DNA, 22 bp, Artificial Sequence
  chemically synthesized
caaaggacatgaactcatcatt

SEQ ID NO: 1396427 - DNA, 22 bp, Artificial Sequence
  chemically synthesized
atccatgtccctacaaaggaca

SEQ ID NO: 1396428 - DNA, 22 bp, Artificial Sequence
  chemically synthesized
catccatgtccctacaaaggac

SEQ ID NO: 1396429 - DNA, 22 bp, Artificial Sequence
  chemically synthesized
caatttcatccatgtccctaca

SEQ ID NO: 1396430 - DNA, 22 bp, Artificial Sequence
  chemically synthesized
ccaatttcatccatgtccctac

SEQ ID NO: 1396431 - DNA, 22 bp, Artificial Sequence
  chemically synthesized
atgtcctttgtagggacatgga

SEQ ID NO: 1396432 - DNA, 22 bp, Artificial Sequence
  chemically synthesized
tgtagggacatggatgaaattg

SEQ ID NO: 1396433 - DNA, 22 bp, Artificial Sequence
  chemically synthesized
gtagggacatggatgaaattgg

SEQ ID NO: 1396434 - DNA, 22 bp, Artificial Sequence
  chemically synthesized
tagggacatggatgaaattgga

SEQ ID NO: 1396435 - DNA, 22 bp, Artificial Sequence
  chemically synthesized
agaatgatgatttccaatttca

SEQ ID NO: 1396436 - DNA, 22 bp, Artificial Sequence
  chemically synthesized
ctgagaatgatgatttccaatt

SEQ ID NO: 1396437 - DNA, 22 bp, Artificial Sequence
  chemically synthesized
gctgagaatgatgatttccaat

SEQ ID NO: 1396438 - DNA, 22 bp, Artificial Sequence
  chemically synthesized
caatggtttgctgagaatgatg

SEQ ID NO: 1396439 - DNA, 22 bp, Artificial Sequence
  chemically synthesized
gcaatggtttgctgagaatgat

SEQ ID NO: 1396440 - DNA, 22 bp, Artificial Sequence
  chemically synthesized
tccttgcaatggtttgctgaga

SEQ ID NO: 1396441 - DNA, 22 bp, Artificial Sequence
  chemically synthesized
gaaatcatcattctcagcaaac

SEQ ID NO: 1396442 - DNA, 22 bp, Artificial Sequence
  chemically synthesized
gtccttgcaatggtttgctgag

SEQ ID NO: 1396443 - DNA, 22 bp, Artificial Sequence
  chemically synthesized
tgtccttgcaatggtttgctga

SEQ ID NO: 1396444 - DNA, 22 bp, Artificial Sequence
  chemically synthesized
ttgtccttgcaatggtttgctg

SEQ ID NO: 1396445 - DNA, 22 bp, Artificial Sequence
  chemically synthesized
tttgtccttgcaatggtttgct

SEQ ID NO: 1396446 - DNA, 22 bp, Artificial Sequence
  chemically synthesized
gttttttgtccttgcaatggtt

SEQ ID NO: 1396447 - DNA, 22 bp, Artificial Sequence
  chemically synthesized
ggttttttgtccttgcaatggt

SEQ ID NO: 1396448 - DNA, 22 bp, Artificial Sequence
  chemically synthesized
tcagcaaaccattgcaaggaca

SEQ ID NO: 1396449 - DNA, 22 bp, Artificial Sequence
  chemically synthesized
agcaaaccattgcaaggacaaa

SEQ ID NO: 1396450 - DNA, 22 bp, Artificial Sequence
  chemically synthesized
caaggacaaaaaaccaaacacc

SEQ ID NO: 1396451 - DNA, 22 bp, Artificial Sequence
  chemically synthesized
tgagtgagaacatgcggtgttt

SEQ ID NO: 1396452 - DNA, 22 bp, Artificial Sequence
  chemically synthesized
ccacctatgagtgagaacatgc

SEQ ID NO: 1396453 - DNA, 22 bp, Artificial Sequence
  chemically synthesized
agttcccacctatgagtgagaa

SEQ ID NO: 1396454 - DNA, 22 bp, Artificial Sequence
  chemically synthesized
ttcagttcccacctatgagtga

SEQ ID NO: 1396455 - DNA, 22 bp, Artificial Sequence
  chemically synthesized
attgttcagttcccacctatga

SEQ ID NO: 1396456 - DNA, 22 bp, Artificial Sequence
  chemically synthesized
tcattgttcagttcccacctat

SEQ ID NO: 1396457 - DNA, 22 bp, Artificial Sequence
  chemically synthesized
tcactcataggtgggaactgaa

SEQ ID NO: 1396458 - DNA, 22 bp, Artificial Sequence
  chemically synthesized
actcataggtgggaactgaaca

SEQ ID NO: 1396459 - DNA, 22 bp, Artificial Sequence
  chemically synthesized
ataggtgggaactgaacaatga

SEQ ID NO: 1396460 - DNA, 22 bp, Artificial Sequence
  chemically synthesized
cgtccatgtgttctcattgttc

SEQ ID NO: 1396461 - DNA, 22 bp, Artificial Sequence
  chemically synthesized
ctgcgtccatgtgttctcattg

SEQ ID NO: 1396462 - DNA, 22 bp, Artificial Sequence
  chemically synthesized
cctgcgtccatgtgttctcatt

SEQ ID NO: 1396463 - DNA, 22 bp, Artificial Sequence
  chemically synthesized
cccttcctgcgtccatgtgttc

SEQ ID NO: 1396464 - DNA, 22 bp, Artificial Sequence
  chemically synthesized
aacaatgagaacacatggacgc

SEQ ID NO: 1396465 - DNA, 22 bp, Artificial Sequence
  chemically synthesized
cccccaccccacaacagtcccc

SEQ ID NO: 1396466 - DNA, 22 bp, Artificial Sequence
  chemically synthesized
ccccctccccccaccccacaac

SEQ ID NO: 1396467 - DNA, 22 bp, Artificial Sequence
  chemically synthesized
cggggactgttgtggggtgggg

SEQ ID NO: 1396468 - DNA, 22 bp, Artificial Sequence
  chemically synthesized
tccctcccccctccccccaccc

SEQ ID NO: 1396469 - DNA, 22 bp, Artificial Sequence
  chemically synthesized
atgctatccctcccccctcccc

SEQ ID NO: 1396470 - DNA, 22 bp, Artificial Sequence
  chemically synthesized
ttgtggggtggggggagggggg

SEQ ID NO: 1396471 - DNA, 22 bp, Artificial Sequence
  chemically synthesized
ctaatgctatccctcccccctc

SEQ ID NO: 1396472 - DNA, 22 bp, Artificial Sequence
  chemically synthesized
tggggtggggggaggggggagg

SEQ ID NO: 1396473 - DNA, 22 bp, Artificial Sequence
  chemically synthesized
ggtatatctcctaatgctatcc

SEQ ID NO: 1396474 - DNA, 22 bp, Artificial Sequence
  chemically synthesized
gcattaggtatatctcctaatg

SEQ ID NO: 1396475 - DNA, 22 bp, Artificial Sequence
  chemically synthesized
agcattaggtatatctcctaat

SEQ ID NO: 1396476 - DNA, 22 bp, Artificial Sequence
  chemically synthesized
gtcatttagcattaggtatatc

SEQ ID NO: 1396477 - DNA, 22 bp, Artificial Sequence
  chemically synthesized
actcgtcatttagcattaggta

SEQ ID NO: 1396478 - DNA, 22 bp, Artificial Sequence
  chemically synthesized
ggagatatacctaatgctaaat

SEQ ID NO: 1396479 - DNA, 22 bp, Artificial Sequence
  chemically synthesized
cacccattaactcgtcatttag

SEQ ID NO: 1396480 - DNA, 22 bp, Artificial Sequence
  chemically synthesized
gtgtgctgcacccattaactcg

SEQ ID NO: 1396481 - DNA, 22 bp, Artificial Sequence
  chemically synthesized
atgctaaatgacgagttaatgg

SEQ ID NO: 1396482 - DNA, 22 bp, Artificial Sequence
  chemically synthesized
aatgacgagttaatgggtgcag

SEQ ID NO: 1396483 - DNA, 22 bp, Artificial Sequence
  chemically synthesized
atgggtgcagcacaccagcatg

SEQ ID NO: 1396484 - DNA, 22 bp, Artificial Sequence
  chemically synthesized
cgtatgtatacatgtgccatgc

SEQ ID NO: 1396485 - DNA, 22 bp, Artificial Sequence
  chemically synthesized
gttacgtatgtatacatgtgcc

SEQ ID NO: 1396486 - DNA, 22 bp, Artificial Sequence
  chemically synthesized
gggtacatgtgcacaatgtgca

SEQ ID NO: 1396487 - DNA, 22 bp, Artificial Sequence
  chemically synthesized
agggtacatgtgcacaatgtgc

SEQ ID NO: 1396488 - DNA, 22 bp, Artificial Sequence
  chemically synthesized
tagggtacatgtgcacaatgtg

SEQ ID NO: 1396489 - DNA, 22 bp, Artificial Sequence
  chemically synthesized
agttttagggtacatgtgcaca

SEQ ID NO: 1396490 - DNA, 22 bp, Artificial Sequence
  chemically synthesized
acctgcacattgtgcacatgta

SEQ ID NO: 1396491 - DNA, 22 bp, Artificial Sequence
  chemically synthesized
taagttttagggtacatgtgca

SEQ ID NO: 1396492 - DNA, 22 bp, Artificial Sequence
  chemically synthesized
cacattgtgcacatgtacccta

SEQ ID NO: 1396493 - DNA, 22 bp, Artificial Sequence
  chemically synthesized
tactctaagttttagggtacat

SEQ ID NO: 1396494 - DNA, 22 bp, Artificial Sequence
  chemically synthesized
ttatactctaagttttagggta

SEQ ID NO: 1396495 - DNA, 22 bp, Artificial Sequence
  chemically synthesized
ttattatactctaagttttagg

SEQ ID NO: 1396496 - DNA, 22 bp, Artificial Sequence
  chemically synthesized
tgcacatgtaccctaaaactta

SEQ ID NO: 1396497 - DNA, 22 bp, Artificial Sequence
  chemically synthesized
ttattattatactctaagtttt

SEQ ID NO: 1396498 - DNA, 22 bp, Artificial Sequence
  chemically synthesized
attattattatactctaagttt

SEQ ID NO: 1396499 - DNA, 22 bp, Artificial Sequence
  chemically synthesized
tattattattatactctaagtt

SEQ ID NO: 1396500 - DNA, 22 bp, Artificial Sequence
  chemically synthesized
aattttattattattatactct

SEQ ID NO: 1396501 - DNA, 22 bp, Artificial Sequence
  chemically synthesized
aaattttattattattatactc

SEQ ID NO: 1396502 - DNA, 22 bp, Artificial Sequence
  chemically synthesized
taaattttattattattatact

SEQ ID NO: 1396503 - DNA, 22 bp, Artificial Sequence
  chemically synthesized
ttaaattttattattattatac

SEQ ID NO: 1396504 - DNA, 22 bp, Artificial Sequence
  chemically synthesized
tttaaattttattattattata

SEQ ID NO: 1396505 - DNA, 22 bp, Artificial Sequence
  chemically synthesized
ttttaaattttattattattat

SEQ ID NO: 1396506 - DNA, 22 bp, Artificial Sequence
  chemically synthesized
aaacttagagtataataataat

SEQ ID NO: 1396507 - DNA, 22 bp, Artificial Sequence
  chemically synthesized
tttttaaattttattattatta

SEQ ID NO: 1396508 - DNA, 22 bp, Artificial Sequence
  chemically synthesized
agagtataataataataaaatt

SEQ ID NO: 1396509 - DNA, 22 bp, Artificial Sequence
  chemically synthesized
gcattttttttaaattttatta

SEQ ID NO: 1396510 - DNA, 22 bp, Artificial Sequence
  chemically synthesized
gagtataataataataaaattt

SEQ ID NO: 1396511 - DNA, 22 bp, Artificial Sequence
  chemically synthesized
ggcattttttttaaattttatt

SEQ ID NO: 1396512 - DNA, 22 bp, Artificial Sequence
  chemically synthesized
tatttggcattttttttaaatt

SEQ ID NO: 1396513 - DNA, 22 bp, Artificial Sequence
  chemically synthesized
aagttatatttggcattttttt

SEQ ID NO: 1396514 - DNA, 22 bp, Artificial Sequence
  chemically synthesized
gaagttatatttggcatttttt

SEQ ID NO: 1396515 - DNA, 22 bp, Artificial Sequence
  chemically synthesized
tgaagttatatttggcattttt

SEQ ID NO: 1396516 - DNA, 22 bp, Artificial Sequence
  chemically synthesized
ttgaagttatatttggcatttt

SEQ ID NO: 1396517 - DNA, 22 bp, Artificial Sequence
  chemically synthesized
tttgaagttatatttggcattt

SEQ ID NO: 1396518 - DNA, 22 bp, Artificial Sequence
  chemically synthesized
ttttgaagttatatttggcatt

SEQ ID NO: 1396519 - DNA, 22 bp, Artificial Sequence
  chemically synthesized
tttttgaagttatatttggcat

SEQ ID NO: 1396520 - DNA, 22 bp, Artificial Sequence
  chemically synthesized
ttttttgaagttatatttggca

SEQ ID NO: 1396521 - DNA, 22 bp, Artificial Sequence
  chemically synthesized
tttttttgaagttatatttggc

SEQ ID NO: 1396522 - DNA, 22 bp, Artificial Sequence
  chemically synthesized
ttttttttgaagttatatttgg

SEQ ID NO: 1396523 - DNA, 22 bp, Artificial Sequence
  chemically synthesized
tttttttttgaagttatatttg

SEQ ID NO: 1396524 - DNA, 22 bp, Artificial Sequence
  chemically synthesized
aaaaaaaatgccaaatataact

SEQ ID NO: 1396525 - DNA, 22 bp, Artificial Sequence
  chemically synthesized
ttttttttttgaagttatattt

SEQ ID NO: 1396526 - DNA, 22 bp, Artificial Sequence
  chemically synthesized
aaaaaaatgccaaatataactt

SEQ ID NO: 1396527 - DNA, 22 bp, Artificial Sequence
  chemically synthesized
tttttttttttgaagttatatt

SEQ ID NO: 1396528 - DNA, 22 bp, Artificial Sequence
  chemically synthesized
ttttttttttttgaagttatat

SEQ ID NO: 1396529 - DNA, 22 bp, Artificial Sequence
  chemically synthesized
ttttttttttttttgaagttat

SEQ ID NO: 1396530 - DNA, 22 bp, Artificial Sequence
  chemically synthesized
cttttttttttttttgaagtta

SEQ ID NO: 1396531 - DNA, 22 bp, Artificial Sequence
  chemically synthesized
ggtatagatttctttttttttt

SEQ ID NO: 1396532 - DNA, 22 bp, Artificial Sequence
  chemically synthesized
aattaggtatagatttcttttt

SEQ ID NO: 1396533 - DNA, 22 bp, Artificial Sequence
  chemically synthesized
caaaaaaaaaaaaaagaaatct

SEQ ID NO: 1396534 - DNA, 22 bp, Artificial Sequence
  chemically synthesized
aaaaaaaaaaaaaagaaatcta

SEQ ID NO: 1396535 - DNA, 22 bp, Artificial Sequence
  chemically synthesized
ctaaattaggtatagatttctt

SEQ ID NO: 1396536 - DNA, 22 bp, Artificial Sequence
  chemically synthesized
tctcctaaattaggtatagatt

SEQ ID NO: 1396537 - DNA, 22 bp, Artificial Sequence
  chemically synthesized
gtctcctaaattaggtatagat

SEQ ID NO: 1396538 - DNA, 22 bp, Artificial Sequence
  chemically synthesized
tgtctcctaaattaggtataga

SEQ ID NO: 1396539 - DNA, 22 bp, Artificial Sequence
  chemically synthesized
ttttgtctcctaaattaggtat

SEQ ID NO: 1396540 - DNA, 22 bp, Artificial Sequence
  chemically synthesized
gttttgtctcctaaattaggta

SEQ ID NO: 1396541 - DNA, 22 bp, Artificial Sequence
  chemically synthesized
gtttgttttgtctcctaaatta

SEQ ID NO: 1396542 - DNA, 22 bp, Artificial Sequence
  chemically synthesized
acattagtttgttttgtctcct

SEQ ID NO: 1396543 - DNA, 22 bp, Artificial Sequence
  chemically synthesized
tacctaatttaggagacaaaac

SEQ ID NO: 1396544 - DNA, 22 bp, Artificial Sequence
  chemically synthesized
tgacattagtttgttttgtctc

SEQ ID NO: 1396545 - DNA, 22 bp, Artificial Sequence
  chemically synthesized
ctgacattagtttgttttgtct

SEQ ID NO: 1396546 - DNA, 22 bp, Artificial Sequence
  chemically synthesized
atttaggagacaaaacaaacta

SEQ ID NO: 1396547 - DNA, 22 bp, Artificial Sequence
  chemically synthesized
aggagacaaaacaaactaatgt

SEQ ID NO: 1396548 - DNA, 22 bp, Artificial Sequence
  chemically synthesized
ggagacaaaacaaactaatgtc

SEQ ID NO: 1396549 - DNA, 22 bp, Artificial Sequence
  chemically synthesized
cagaagtgtgcaaacaaacttc

SEQ ID NO: 1396550 - DNA, 22 bp, Artificial Sequence
  chemically synthesized
attacagaagtgtgcaaacaaa

SEQ ID NO: 1396551 - DNA, 22 bp, Artificial Sequence
  chemically synthesized
atgtcagaagtttgtttgcaca

SEQ ID NO: 1396552 - DNA, 22 bp, Artificial Sequence
  chemically synthesized
tagttaattacagaagtgtgca

SEQ ID NO: 1396553 - DNA, 22 bp, Artificial Sequence
  chemically synthesized
gtagttaattacagaagtgtgc

SEQ ID NO: 1396554 - DNA, 22 bp, Artificial Sequence
  chemically synthesized
gtttgcacacttctgtaattaa

SEQ ID NO: 1396555 - DNA, 22 bp, Artificial Sequence
  chemically synthesized
tttgcacacttctgtaattaac

SEQ ID NO: 1396556 - DNA, 22 bp, Artificial Sequence
  chemically synthesized
aatatatgtttgtagttaatta

SEQ ID NO: 1396557 - DNA, 22 bp, Artificial Sequence
  chemically synthesized
gcacacttctgtaattaactac

SEQ ID NO: 1396558 - DNA, 22 bp, Artificial Sequence
  chemically synthesized
gaatatatgtttgtagttaatt

SEQ ID NO: 1396559 - DNA, 22 bp, Artificial Sequence
  chemically synthesized
cacacttctgtaattaactaca

SEQ ID NO: 1396560 - DNA, 22 bp, Artificial Sequence
  chemically synthesized
ttgaatatatgtttgtagttaa

SEQ ID NO: 1396561 - DNA, 22 bp, Artificial Sequence
  chemically synthesized
ctgtaattaactacaaacatat

SEQ ID NO: 1396562 - DNA, 22 bp, Artificial Sequence
  chemically synthesized
tgtaattaactacaaacatata

SEQ ID NO: 1396563 - DNA, 22 bp, Artificial Sequence
  chemically synthesized
taattaactacaaacatatatt

SEQ ID NO: 1396564 - DNA, 22 bp, Artificial Sequence
  chemically synthesized
actacaaacatatattcaagag

SEQ ID NO: 1396565 - DNA, 22 bp, Artificial Sequence
  chemically synthesized
caaacatatattcaagagtatt

SEQ ID NO: 1396566 - DNA, 22 bp, Artificial Sequence
  chemically synthesized
taacatagaatgaaatgataag

SEQ ID NO: 1396567 - DNA, 22 bp, Artificial Sequence
  chemically synthesized
aagagtattctcttatcatttc

SEQ ID NO: 1396568 - DNA, 22 bp, Artificial Sequence
  chemically synthesized
ataacatagaatgaaatgataa

SEQ ID NO: 1396569 - DNA, 22 bp, Artificial Sequence
  chemically synthesized
tataacatagaatgaaatgata

SEQ ID NO: 1396570 - DNA, 22 bp, Artificial Sequence
  chemically synthesized
ttataacatagaatgaaatgat

SEQ ID NO: 1396571 - DNA, 22 bp, Artificial Sequence
  chemically synthesized
tttataacatagaatgaaatga

SEQ ID NO: 1396572 - DNA, 22 bp, Artificial Sequence
  chemically synthesized
tcttatcatttcattctatgtt

SEQ ID NO: 1396573 - DNA, 22 bp, Artificial Sequence
  chemically synthesized
aaggttttttataacatagaat

SEQ ID NO: 1396574 - DNA, 22 bp, Artificial Sequence
  chemically synthesized
ttatcatttcattctatgttat

SEQ ID NO: 1396575 - DNA, 22 bp, Artificial Sequence
  chemically synthesized
atcatttcattctatgttataa

SEQ ID NO: 1396576 - DNA, 22 bp, Artificial Sequence
  chemically synthesized
tcatttcattctatgttataaa

SEQ ID NO: 1396577 - DNA, 22 bp, Artificial Sequence
  chemically synthesized
tgagactgaaggttttttataa

SEQ ID NO: 1396578 - DNA, 22 bp, Artificial Sequence
  chemically synthesized
atgagactgaaggttttttata

SEQ ID NO: 1396579 - DNA, 22 bp, Artificial Sequence
  chemically synthesized
cattctatgttataaaaaacct

SEQ ID NO: 1396580 - DNA, 22 bp, Artificial Sequence
  chemically synthesized
attctatgttataaaaaacctt

SEQ ID NO: 1396581 - DNA, 22 bp, Artificial Sequence
  chemically synthesized
tatgttataaaaaaccttcagt

SEQ ID NO: 1396582 - DNA, 22 bp, Artificial Sequence
  chemically synthesized
tgttataaaaaaccttcagtct

SEQ ID NO: 1396583 - DNA, 22 bp, Artificial Sequence
  chemically synthesized
taatgtgacttatgagactgaa

SEQ ID NO: 1396584 - DNA, 22 bp, Artificial Sequence
  chemically synthesized
tataatgtgacttatgagactg

SEQ ID NO: 1396585 - DNA, 22 bp, Artificial Sequence
  chemically synthesized
taaaaaaccttcagtctcataa

SEQ ID NO: 1396586 - DNA, 22 bp, Artificial Sequence
  chemically synthesized
cagtctcataagtcacattata

SEQ ID NO: 1396587 - DNA, 22 bp, Artificial Sequence
  chemically synthesized
agtctcataagtcacattatag

SEQ ID NO: 1396588 - DNA, 22 bp, Artificial Sequence
  chemically synthesized
ataagtcacattatagagcatt

SEQ ID NO: 1396589 - DNA, 22 bp, Artificial Sequence
  chemically synthesized
accatgggaggaaaacgtaatg

SEQ ID NO: 1396590 - DNA, 22 bp, Artificial Sequence
  chemically synthesized
caccatgggaggaaaacgtaat

SEQ ID NO: 1396591 - DNA, 22 bp, Artificial Sequence
  chemically synthesized
tcaccatgggaggaaaacgtaa

SEQ ID NO: 1396592 - DNA, 22 bp, Artificial Sequence
  chemically synthesized
ttcaccatgggaggaaaacgta

SEQ ID NO: 1396593 - DNA, 22 bp, Artificial Sequence
  chemically synthesized
tagagcattacgttttcctccc

SEQ ID NO: 1396594 - DNA, 22 bp, Artificial Sequence
  chemically synthesized
atccttttcaccatgggaggaa

SEQ ID NO: 1396595 - DNA, 22 bp, Artificial Sequence
  chemically synthesized
agaactaatccttttcaccatg

SEQ ID NO: 1396596 - DNA, 22 bp, Artificial Sequence
  chemically synthesized
cgttttcctcccatggtgaaaa

SEQ ID NO: 1396597 - DNA, 22 bp, Artificial Sequence
  chemically synthesized
ctaagaactaatccttttcacc

SEQ ID NO: 1396598 - DNA, 22 bp, Artificial Sequence
  chemically synthesized
tcctcccatggtgaaaaggatt

SEQ ID NO: 1396599 - DNA, 22 bp, Artificial Sequence
  chemically synthesized
ttgctaagaactaatccttttc

SEQ ID NO: 1396600 - DNA, 22 bp, Artificial Sequence
  chemically synthesized
cctcccatggtgaaaaggatta

SEQ ID NO: 1396601 - DNA, 22 bp, Artificial Sequence
  chemically synthesized
ctcccatggtgaaaaggattag

SEQ ID NO: 1396602 - DNA, 22 bp, Artificial Sequence
  chemically synthesized
ccatggtgaaaaggattagttc

SEQ ID NO: 1396603 - DNA, 22 bp, Artificial Sequence
  chemically synthesized
agttattgctaagaactaatcc

SEQ ID NO: 1396604 - DNA, 22 bp, Artificial Sequence
  chemically synthesized
aagttattgctaagaactaatc

SEQ ID NO: 1396605 - DNA, 22 bp, Artificial Sequence
  chemically synthesized
ttaagttattgctaagaactaa

SEQ ID NO: 1396606 - DNA, 22 bp, Artificial Sequence
  chemically synthesized
gttcttagcaataacttaagaa

SEQ ID NO: 1396607 - DNA, 22 bp, Artificial Sequence
  chemically synthesized
acaaaagatgtgttcttaagtt

SEQ ID NO: 1396608 - DNA, 22 bp, Artificial Sequence
  chemically synthesized
ttagcaataacttaagaacaca

SEQ ID NO: 1396609 - DNA, 22 bp, Artificial Sequence
  chemically synthesized
agcaataacttaagaacacatc

SEQ ID NO: 1396610 - DNA, 22 bp, Artificial Sequence
  chemically synthesized
gcaataacttaagaacacatct

SEQ ID NO: 1396611 - DNA, 22 bp, Artificial Sequence
  chemically synthesized
agagacactgacaaaagatgtg

SEQ ID NO: 1396612 - DNA, 22 bp, Artificial Sequence
  chemically synthesized
tccctcagagacactgacaaaa

SEQ ID NO: 1396613 - DNA, 22 bp, Artificial Sequence
  chemically synthesized
aagaacacatcttttgtcagtg

SEQ ID NO: 1396614 - DNA, 22 bp, Artificial Sequence
  chemically synthesized
atccctcagagacactgacaaa

SEQ ID NO: 1396615 - DNA, 22 bp, Artificial Sequence
  chemically synthesized
agaacacatcttttgtcagtgt

SEQ ID NO: 1396616 - DNA, 22 bp, Artificial Sequence
  chemically synthesized
ttgtcagtgtctctgagggata

SEQ ID NO: 1396617 - DNA, 22 bp, Artificial Sequence
  chemically synthesized
tgtcagtgtctctgagggataa

SEQ ID NO: 1396618 - DNA, 22 bp, Artificial Sequence
  chemically synthesized
gtcagtgtctctgagggataaa

SEQ ID NO: 1396619 - DNA, 22 bp, Artificial Sequence
  chemically synthesized
aaccaggaaatatttatccctc

SEQ ID NO: 1396620 - DNA, 22 bp, Artificial Sequence
  chemically synthesized
tcagtgtctctgagggataaat

SEQ ID NO: 1396621 - DNA, 22 bp, Artificial Sequence
  chemically synthesized
tgagggataaatatttcctggt

SEQ ID NO: 1396622 - DNA, 22 bp, Artificial Sequence
  chemically synthesized
agggataaatatttcctggttg

SEQ ID NO: 1396623 - DNA, 22 bp, Artificial Sequence
  chemically synthesized
tgcataaacactcaaccaggaa

SEQ ID NO: 1396624 - DNA, 22 bp, Artificial Sequence
  chemically synthesized
tgtgcataaacactcaaccagg

SEQ ID NO: 1396625 - DNA, 22 bp, Artificial Sequence
  chemically synthesized
ctctgtgcataaacactcaacc

SEQ ID NO: 1396626 - DNA, 22 bp, Artificial Sequence
  chemically synthesized
cctctgtgcataaacactcaac

SEQ ID NO: 1396627 - DNA, 22 bp, Artificial Sequence
  chemically synthesized
tcctctgtgcataaacactcaa

SEQ ID NO: 1396628 - DNA, 22 bp, Artificial Sequence
  chemically synthesized
ttcctctgtgcataaacactca

SEQ ID NO: 1396629 - DNA, 22 bp, Artificial Sequence
  chemically synthesized
cctggttgagtgtttatgcaca

SEQ ID NO: 1396630 - DNA, 22 bp, Artificial Sequence
  chemically synthesized
ctggttgagtgtttatgcacag

SEQ ID NO: 1396631 - DNA, 22 bp, Artificial Sequence
  chemically synthesized
agtaatttttcctctgtgcata

SEQ ID NO: 1396632 - DNA, 22 bp, Artificial Sequence
  chemically synthesized
cagtaatttttcctctgtgcat

SEQ ID NO: 1396633 - DNA, 22 bp, Artificial Sequence
  chemically synthesized
gttgagtgtttatgcacagagg

SEQ ID NO: 1396634 - DNA, 22 bp, Artificial Sequence
  chemically synthesized
agtgtttatgcacagaggaaaa

SEQ ID NO: 1396635 - DNA, 22 bp, Artificial Sequence
  chemically synthesized
ggcacagacttcagtaattttt

SEQ ID NO: 1396636 - DNA, 22 bp, Artificial Sequence
  chemically synthesized
atgcacagaggaaaaattactg

SEQ ID NO: 1396637 - DNA, 22 bp, Artificial Sequence
  chemically synthesized
gggcacagacttcagtaatttt

SEQ ID NO: 1396638 - DNA, 22 bp, Artificial Sequence
  chemically synthesized
tgcacagaggaaaaattactga

SEQ ID NO: 1396639 - DNA, 22 bp, Artificial Sequence
  chemically synthesized
tatttgggcacagacttcagta

SEQ ID NO: 1396640 - DNA, 22 bp, Artificial Sequence
  chemically synthesized
cagaagctatatttgggcacag

SEQ ID NO: 1396641 - DNA, 22 bp, Artificial Sequence
  chemically synthesized
acagaagctatatttgggcaca

SEQ ID NO: 1396642 - DNA, 22 bp, Artificial Sequence
  chemically synthesized
ctgaagtctgtgcccaaatata

SEQ ID NO: 1396643 - DNA, 22 bp, Artificial Sequence
  chemically synthesized
aagtttacagaagctatatttg

SEQ ID NO: 1396644 - DNA, 22 bp, Artificial Sequence
  chemically synthesized
aagtctgtgcccaaatatagct

SEQ ID NO: 1396645 - DNA, 22 bp, Artificial Sequence
  chemically synthesized
caagtttacagaagctatattt

SEQ ID NO: 1396646 - DNA, 22 bp, Artificial Sequence
  chemically synthesized
tcaagtttacagaagctatatt

SEQ ID NO: 1396647 - DNA, 22 bp, Artificial Sequence
  chemically synthesized
ttcaagtttacagaagctatat

SEQ ID NO: 1396648 - DNA, 22 bp, Artificial Sequence
  chemically synthesized
tgcccaaatatagcttctgtaa

SEQ ID NO: 1396649 - DNA, 22 bp, Artificial Sequence
  chemically synthesized
tatttttcaagtttacagaagc

SEQ ID NO: 1396650 - DNA, 22 bp, Artificial Sequence
  chemically synthesized
atatttttcaagtttacagaag

SEQ ID NO: 1396651 - DNA, 22 bp, Artificial Sequence
  chemically synthesized
tatatttttcaagtttacagaa

SEQ ID NO: 1396652 - DNA, 22 bp, Artificial Sequence
  chemically synthesized
ttatatttttcaagtttacaga

SEQ ID NO: 1396653 - DNA, 22 bp, Artificial Sequence
  chemically synthesized
ttttatatttttcaagtttaca

SEQ ID NO: 1396654 - DNA, 22 bp, Artificial Sequence
  chemically synthesized
tcttttatatttttcaagttta

SEQ ID NO: 1396655 - DNA, 22 bp, Artificial Sequence
  chemically synthesized
aattctcttttatatttttcaa

SEQ ID NO: 1396656 - DNA, 22 bp, Artificial Sequence
  chemically synthesized
ctgtaaacttgaaaaatataaa

SEQ ID NO: 1396657 - DNA, 22 bp, Artificial Sequence
  chemically synthesized
actaaattctcttttatatttt

SEQ ID NO: 1396658 - DNA, 22 bp, Artificial Sequence
  chemically synthesized
tgtaaacttgaaaaatataaaa

SEQ ID NO: 1396659 - DNA, 22 bp, Artificial Sequence
  chemically synthesized
taaacttgaaaaatataaaaga

SEQ ID NO: 1396660 - DNA, 22 bp, Artificial Sequence
  chemically synthesized
ctcactaaattctcttttatat

SEQ ID NO: 1396661 - DNA, 22 bp, Artificial Sequence
  chemically synthesized
cctcactaaattctcttttata

SEQ ID NO: 1396662 - DNA, 22 bp, Artificial Sequence
  chemically synthesized
tcctcactaaattctcttttat

SEQ ID NO: 1396663 - DNA, 22 bp, Artificial Sequence
  chemically synthesized
ctttcctcactaaattctcttt

SEQ ID NO: 1396664 - DNA, 22 bp, Artificial Sequence
  chemically synthesized
gaaaaatataaaagagaattta

SEQ ID NO: 1396665 - DNA, 22 bp, Artificial Sequence
  chemically synthesized
aaaaatataaaagagaatttag

SEQ ID NO: 1396666 - DNA, 22 bp, Artificial Sequence
  chemically synthesized
tctcctttcctcactaaattct

SEQ ID NO: 1396667 - DNA, 22 bp, Artificial Sequence
  chemically synthesized
tgtctcctttcctcactaaatt

SEQ ID NO: 1396668 - DNA, 22 bp, Artificial Sequence
  chemically synthesized
tctgtctcctttcctcactaaa

SEQ ID NO: 1396669 - DNA, 22 bp, Artificial Sequence
  chemically synthesized
ctctctgtctcctttcctcact

SEQ ID NO: 1396670 - DNA, 22 bp, Artificial Sequence
  chemically synthesized
agtgaggaaaggagacagagag

SEQ ID NO: 1396671 - DNA, 22 bp, Artificial Sequence
  chemically synthesized
gtgaggaaaggagacagagagt

SEQ ID NO: 1396672 - DNA, 22 bp, Artificial Sequence
  chemically synthesized
tagtccaaaaggagctactctc

SEQ ID NO: 1396673 - DNA, 22 bp, Artificial Sequence
  chemically synthesized
tattatagtccaaaaggagcta

SEQ ID NO: 1396674 - DNA, 22 bp, Artificial Sequence
  chemically synthesized
gtattatagtccaaaaggagct

SEQ ID NO: 1396675 - DNA, 22 bp, Artificial Sequence
  chemically synthesized
gaaaatgtgtttgtattatagt

SEQ ID NO: 1396676 - DNA, 22 bp, Artificial Sequence
  chemically synthesized
agaaaatgtgtttgtattatag

SEQ ID NO: 1396677 - DNA, 22 bp, Artificial Sequence
  chemically synthesized
ttagaaaatgtgtttgtattat

SEQ ID NO: 1396678 - DNA, 22 bp, Artificial Sequence
  chemically synthesized
cttttggactataatacaaaca

SEQ ID NO: 1396679 - DNA, 22 bp, Artificial Sequence
  chemically synthesized
gttcttagaaaatgtgtttgta

SEQ ID NO: 1396680 - DNA, 22 bp, Artificial Sequence
  chemically synthesized
ttggactataatacaaacacat

SEQ ID NO: 1396681 - DNA, 22 bp, Artificial Sequence
  chemically synthesized
tggactataatacaaacacatt

SEQ ID NO: 1396682 - DNA, 22 bp, Artificial Sequence
  chemically synthesized
ggactataatacaaacacattt

SEQ ID NO: 1396683 - DNA, 22 bp, Artificial Sequence
  chemically synthesized
gactataatacaaacacatttt

SEQ ID NO: 1396684 - DNA, 22 bp, Artificial Sequence
  chemically synthesized
taatacaaacacattttctaag

SEQ ID NO: 1396685 - DNA, 22 bp, Artificial Sequence
  chemically synthesized
tgatccccaaggcctagttctt

SEQ ID NO: 1396686 - DNA, 22 bp, Artificial Sequence
  chemically synthesized
attatgatccccaaggcctagt

SEQ ID NO: 1396687 - DNA, 22 bp, Artificial Sequence
  chemically synthesized
gttgattatgatccccaaggcc

SEQ ID NO: 1396688 - DNA, 22 bp, Artificial Sequence
  chemically synthesized
tctaagaactaggccttgggga

SEQ ID NO: 1396689 - DNA, 22 bp, Artificial Sequence
  chemically synthesized
ctaagaactaggccttggggat

SEQ ID NO: 1396690 - DNA, 22 bp, Artificial Sequence
  chemically synthesized
taagaactaggccttggggatc

SEQ ID NO: 1396691 - DNA, 22 bp, Artificial Sequence
  chemically synthesized
agaactaggccttggggatcat

SEQ ID NO: 1396692 - DNA, 22 bp, Artificial Sequence
  chemically synthesized
aggctagttgattatgatcccc

SEQ ID NO: 1396693 - DNA, 22 bp, Artificial Sequence
  chemically synthesized
ggccttggggatcataatcaac

SEQ ID NO: 1396694 - DNA, 22 bp, Artificial Sequence
  chemically synthesized
tgtgtggctcaggctagttgat

SEQ ID NO: 1396695 - DNA, 22 bp, Artificial Sequence
  chemically synthesized
ggggatcataatcaactagcct

SEQ ID NO: 1396696 - DNA, 22 bp, Artificial Sequence
  chemically synthesized
gggatcataatcaactagcctg

SEQ ID NO: 1396697 - DNA, 22 bp, Artificial Sequence
  chemically synthesized
tccattgtgtgtggctcaggct

SEQ ID NO: 1396698 - DNA, 22 bp, Artificial Sequence
  chemically synthesized
gcctgagccacacacaatggat

SEQ ID NO: 1396699 - DNA, 22 bp, Artificial Sequence
  chemically synthesized
agccacacacaatggataggta

SEQ ID NO: 1396700 - DNA, 22 bp, Artificial Sequence
  chemically synthesized
aaaagtgccagtcagaaatacc

SEQ ID NO: 1396701 - DNA, 22 bp, Artificial Sequence
  chemically synthesized
cagctaaaaagtgccagtcaga

SEQ ID NO: 1396702 - DNA, 22 bp, Artificial Sequence
  chemically synthesized
acagctaaaaagtgccagtcag

SEQ ID NO: 1396703 - DNA, 22 bp, Artificial Sequence
  chemically synthesized
ctgactggcactttttagctgt

SEQ ID NO: 1396704 - DNA, 22 bp, Artificial Sequence
  chemically synthesized
atgtcatgccttacagctaaaa

SEQ ID NO: 1396705 - DNA, 22 bp, Artificial Sequence
  chemically synthesized
tgactggcactttttagctgta

SEQ ID NO: 1396706 - DNA, 22 bp, Artificial Sequence
  chemically synthesized
catgtcatgccttacagctaaa

SEQ ID NO: 1396707 - DNA, 22 bp, Artificial Sequence
  chemically synthesized
actggcactttttagctgtaag

SEQ ID NO: 1396708 - DNA, 22 bp, Artificial Sequence
  chemically synthesized
gcactttttagctgtaaggcat

SEQ ID NO: 1396709 - DNA, 22 bp, Artificial Sequence
  chemically synthesized
caatttcatgtcatgccttaca

SEQ ID NO: 1396710 - DNA, 22 bp, Artificial Sequence
  chemically synthesized
attgcaatttcatgtcatgcct

SEQ ID NO: 1396711 - DNA, 22 bp, Artificial Sequence
  chemically synthesized
tttagctgtaaggcatgacatg

SEQ ID NO: 1396712 - DNA, 22 bp, Artificial Sequence
  chemically synthesized
tcattgcaatttcatgtcatgc

SEQ ID NO: 1396713 - DNA, 22 bp, Artificial Sequence
  chemically synthesized
ttagctgtaaggcatgacatga

SEQ ID NO: 1396714 - DNA, 22 bp, Artificial Sequence
  chemically synthesized
tagctgtaaggcatgacatgaa

SEQ ID NO: 1396715 - DNA, 22 bp, Artificial Sequence
  chemically synthesized
tctcattgcaatttcatgtcat

SEQ ID NO: 1396716 - DNA, 22 bp, Artificial Sequence
  chemically synthesized
agctgtaaggcatgacatgaaa

SEQ ID NO: 1396717 - DNA, 22 bp, Artificial Sequence
  chemically synthesized
gctgtaaggcatgacatgaaat

SEQ ID NO: 1396718 - DNA, 22 bp, Artificial Sequence
  chemically synthesized
taaggcatgacatgaaattgca

SEQ ID NO: 1396719 - DNA, 22 bp, Artificial Sequence
  chemically synthesized
tagctctctcattgcaatttca

SEQ ID NO: 1396720 - DNA, 22 bp, Artificial Sequence
  chemically synthesized
gtagctctctcattgcaatttc

SEQ ID NO: 1396721 - DNA, 22 bp, Artificial Sequence
  chemically synthesized
tgtagctctctcattgcaattt

SEQ ID NO: 1396722 - DNA, 22 bp, Artificial Sequence
  chemically synthesized
ttgtagctctctcattgcaatt

SEQ ID NO: 1396723 - DNA, 22 bp, Artificial Sequence
  chemically synthesized
tttgtagctctctcattgcaat

SEQ ID NO: 1396724 - DNA, 22 bp, Artificial Sequence
  chemically synthesized
tggcctttttgtagctctctca

SEQ ID NO: 1396725 - DNA, 22 bp, Artificial Sequence
  chemically synthesized
tatggcctttttgtagctctct

SEQ ID NO: 1396726 - DNA, 22 bp, Artificial Sequence
  chemically synthesized
tctctatggcctttttgtagct

SEQ ID NO: 1396727 - DNA, 22 bp, Artificial Sequence
  chemically synthesized
gtctctatggcctttttgtagc

SEQ ID NO: 1396728 - DNA, 22 bp, Artificial Sequence
  chemically synthesized
caatgagagagctacaaaaagg

SEQ ID NO: 1396729 - DNA, 22 bp, Artificial Sequence
  chemically synthesized
gatacttgtctctatggccttt

SEQ ID NO: 1396730 - DNA, 22 bp, Artificial Sequence
  chemically synthesized
agctggatacttgtctctatgg

SEQ ID NO: 1396731 - DNA, 22 bp, Artificial Sequence
  chemically synthesized
caaaaaggccatagagacaagt

SEQ ID NO: 1396732 - DNA, 22 bp, Artificial Sequence
  chemically synthesized
catagggagaaaggttaagctg

SEQ ID NO: 1396733 - DNA, 22 bp, Artificial Sequence
  chemically synthesized
aacctttctccctatgcagttg

SEQ ID NO: 1396734 - DNA, 22 bp, Artificial Sequence
  chemically synthesized
tggtaaagaagacaactgcata

SEQ ID NO: 1396735 - DNA, 22 bp, Artificial Sequence
  chemically synthesized
acctttctccctatgcagttgt

SEQ ID NO: 1396736 - DNA, 22 bp, Artificial Sequence
  chemically synthesized
tctccctatgcagttgtcttct

SEQ ID NO: 1396737 - DNA, 22 bp, Artificial Sequence
  chemically synthesized
ctccctatgcagttgtcttctt

SEQ ID NO: 1396738 - DNA, 22 bp, Artificial Sequence
  chemically synthesized
tccctatgcagttgtcttcttt

SEQ ID NO: 1396739 - DNA, 22 bp, Artificial Sequence
  chemically synthesized
cctatgcagttgtcttctttac

SEQ ID NO: 1396740 - DNA, 22 bp, Artificial Sequence
  chemically synthesized
tgcagttgtcttctttaccaca

SEQ ID NO: 1396741 - DNA, 22 bp, Artificial Sequence
  chemically synthesized
accagccagcatcactgtggta

SEQ ID NO: 1396742 - DNA, 22 bp, Artificial Sequence
  chemically synthesized
tcttctttaccacagtgatgct

SEQ ID NO: 1396743 - DNA, 22 bp, Artificial Sequence
  chemically synthesized
aattgaccagccagcatcactg

SEQ ID NO: 1396744 - DNA, 22 bp, Artificial Sequence
  chemically synthesized
ctttaccacagtgatgctggct

SEQ ID NO: 1396745 - DNA, 22 bp, Artificial Sequence
  chemically synthesized
tttaccacagtgatgctggctg

SEQ ID NO: 1396746 - DNA, 22 bp, Artificial Sequence
  chemically synthesized
taccacagtgatgctggctggt

SEQ ID NO: 1396747 - DNA, 22 bp, Artificial Sequence
  chemically synthesized
accacagtgatgctggctggtc

SEQ ID NO: 1396748 - DNA, 22 bp, Artificial Sequence
  chemically synthesized
ccacagtgatgctggctggtca

SEQ ID NO: 1396749 - DNA, 22 bp, Artificial Sequence
  chemically synthesized
aagcaggagctaaattgaccag

SEQ ID NO: 1396750 - DNA, 22 bp, Artificial Sequence
  chemically synthesized
gctggtcaatttagctcctgct

SEQ ID NO: 1396751 - DNA, 22 bp, Artificial Sequence
  chemically synthesized
atagtaagtattcaagcaggag

SEQ ID NO: 1396752 - DNA, 22 bp, Artificial Sequence
  chemically synthesized
catagtaagtattcaagcagga

SEQ ID NO: 1396753 - DNA, 22 bp, Artificial Sequence
  chemically synthesized
gtcaatttagctcctgcttgaa

SEQ ID NO: 1396754 - DNA, 22 bp, Artificial Sequence
  chemically synthesized
tcatagtaagtattcaagcagg

SEQ ID NO: 1396755 - DNA, 22 bp, Artificial Sequence
  chemically synthesized
ttcatagtaagtattcaagcag

SEQ ID NO: 1396756 - DNA, 22 bp, Artificial Sequence
  chemically synthesized
ttttcatagtaagtattcaagc

SEQ ID NO: 1396757 - DNA, 22 bp, Artificial Sequence
  chemically synthesized
cttttcatagtaagtattcaag

SEQ ID NO: 1396758 - DNA, 22 bp, Artificial Sequence
  chemically synthesized
agctcctgcttgaatacttact

SEQ ID NO: 1396759 - DNA, 22 bp, Artificial Sequence
  chemically synthesized
gctcctgcttgaatacttacta

SEQ ID NO: 1396760 - DNA, 22 bp, Artificial Sequence
  chemically synthesized
ctgcttgaatacttactatgaa

SEQ ID NO: 1396761 - DNA, 22 bp, Artificial Sequence
  chemically synthesized
cttgaatacttactatgaaaag

SEQ ID NO: 1396762 - DNA, 22 bp, Artificial Sequence
  chemically synthesized
gaatacttactatgaaaagaaa

SEQ ID NO: 1396763 - DNA, 22 bp, Artificial Sequence
  chemically synthesized
aatacttactatgaaaagaaac

SEQ ID NO: 1396764 - DNA, 22 bp, Artificial Sequence
  chemically synthesized
actatgaaaagaaactcttgct

SEQ ID NO: 1396765 - DNA, 22 bp, Artificial Sequence
  chemically synthesized
ctatgaaaagaaactcttgctt

SEQ ID NO: 1396766 - DNA, 22 bp, Artificial Sequence
  chemically synthesized
tgaaaagaaactcttgctttat

SEQ ID NO: 1396767 - DNA, 22 bp, Artificial Sequence
  chemically synthesized
aatgaatgatgcacatgtaaca

SEQ ID NO: 1396768 - DNA, 22 bp, Artificial Sequence
  chemically synthesized
ttgctttatgttacatgtgcat

SEQ ID NO: 1396769 - DNA, 22 bp, Artificial Sequence
  chemically synthesized
tctaaatgaatgatgcacatgt

SEQ ID NO: 1396770 - DNA, 22 bp, Artificial Sequence
  chemically synthesized
gtctaaatgaatgatgcacatg

SEQ ID NO: 1396771 - DNA, 22 bp, Artificial Sequence
  chemically synthesized
gctttatgttacatgtgcatca

SEQ ID NO: 1396772 - DNA, 22 bp, Artificial Sequence
  chemically synthesized
ctttatgttacatgtgcatcat

SEQ ID NO: 1396773 - DNA, 22 bp, Artificial Sequence
  chemically synthesized
tatgttacatgtgcatcattca

SEQ ID NO: 1396774 - DNA, 22 bp, Artificial Sequence
  chemically synthesized
atgttacatgtgcatcattcat

SEQ ID NO: 1396775 - DNA, 22 bp, Artificial Sequence
  chemically synthesized
tgttacatgtgcatcattcatt

SEQ ID NO: 1396776 - DNA, 22 bp, Artificial Sequence
  chemically synthesized
aaaatttgtctaaatgaatgat

SEQ ID NO: 1396777 - DNA, 22 bp, Artificial Sequence
  chemically synthesized
catgtgcatcattcatttagac

SEQ ID NO: 1396778 - DNA, 22 bp, Artificial Sequence
  chemically synthesized
aataagtaaatgcattaaaaat

SEQ ID NO: 1396779 - DNA, 22 bp, Artificial Sequence
  chemically synthesized
caataagtaaatgcattaaaaa

SEQ ID NO: 1396780 - DNA, 22 bp, Artificial Sequence
  chemically synthesized
atttagacaaatttttaatgca

SEQ ID NO: 1396781 - DNA, 22 bp, Artificial Sequence
  chemically synthesized
agacaaatttttaatgcattta

SEQ ID NO: 1396782 - DNA, 22 bp, Artificial Sequence
  chemically synthesized
gacttcaataagtaaatgcatt

SEQ ID NO: 1396783 - DNA, 22 bp, Artificial Sequence
  chemically synthesized
gacaaatttttaatgcatttac

SEQ ID NO: 1396784 - DNA, 22 bp, Artificial Sequence
  chemically synthesized
agacttcaataagtaaatgcat

SEQ ID NO: 1396785 - DNA, 22 bp, Artificial Sequence
  chemically synthesized
tagacttcaataagtaaatgca

SEQ ID NO: 1396786 - DNA, 22 bp, Artificial Sequence
  chemically synthesized
ttaatgcatttacttattgaag

SEQ ID NO: 1396787 - DNA, 22 bp, Artificial Sequence
  chemically synthesized
tgtacctttagacttcaataag

SEQ ID NO: 1396788 - DNA, 22 bp, Artificial Sequence
  chemically synthesized
taatgcatttacttattgaagt

SEQ ID NO: 1396789 - DNA, 22 bp, Artificial Sequence
  chemically synthesized
gtgtacctttagacttcaataa

SEQ ID NO: 1396790 - DNA, 22 bp, Artificial Sequence
  chemically synthesized
aatgcatttacttattgaagtc

SEQ ID NO: 1396791 - DNA, 22 bp, Artificial Sequence
  chemically synthesized
atgcatttacttattgaagtct

SEQ ID NO: 1396792 - DNA, 22 bp, Artificial Sequence
  chemically synthesized
atttgtgtacctttagacttca

SEQ ID NO: 1396793 - DNA, 22 bp, Artificial Sequence
  chemically synthesized
catttgtgtacctttagacttc

SEQ ID NO: 1396794 - DNA, 22 bp, Artificial Sequence
  chemically synthesized
ttcatttgtgtacctttagact

SEQ ID NO: 1396795 - DNA, 22 bp, Artificial Sequence
  chemically synthesized
cttcatttgtgtacctttagac

SEQ ID NO: 1396796 - DNA, 22 bp, Artificial Sequence
  chemically synthesized
acttattgaagtctaaaggtac

SEQ ID NO: 1396797 - DNA, 22 bp, Artificial Sequence
  chemically synthesized
cttattgaagtctaaaggtaca

SEQ ID NO: 1396798 - DNA, 22 bp, Artificial Sequence
  chemically synthesized
attgaagtctaaaggtacacaa

SEQ ID NO: 1396799 - DNA, 22 bp, Artificial Sequence
  chemically synthesized
ttgaagtctaaaggtacacaaa

SEQ ID NO: 1396800 - DNA, 22 bp, Artificial Sequence
  chemically synthesized
aagtctaaaggtacacaaatga

SEQ ID NO: 1396801 - DNA, 22 bp, Artificial Sequence
  chemically synthesized
aaggtacacaaatgaagaagat

SEQ ID NO: 1396802 - DNA, 22 bp, Artificial Sequence
  chemically synthesized
caagatcaggaaccacatcttc

SEQ ID NO: 1396803 - DNA, 22 bp, Artificial Sequence
  chemically synthesized
gaaactgcaagatcaggaacca

SEQ ID NO: 1396804 - DNA, 22 bp, Artificial Sequence
  chemically synthesized
taaactggaaactgcaagatca

SEQ ID NO: 1396805 - DNA, 22 bp, Artificial Sequence
  chemically synthesized
ttataaactggaaactgcaaga

SEQ ID NO: 1396806 - DNA, 22 bp, Artificial Sequence
  chemically synthesized
gttataaactggaaactgcaag

SEQ ID NO: 1396807 - DNA, 22 bp, Artificial Sequence
  chemically synthesized
cttgttataaactggaaactgc

SEQ ID NO: 1396808 - DNA, 22 bp, Artificial Sequence
  chemically synthesized
ttccttgttataaactggaaac

SEQ ID NO: 1396809 - DNA, 22 bp, Artificial Sequence
  chemically synthesized
ctgatcttgcagtttccagttt

SEQ ID NO: 1396810 - DNA, 22 bp, Artificial Sequence
  chemically synthesized
tgttccttgttataaactggaa

SEQ ID NO: 1396811 - DNA, 22 bp, Artificial Sequence
  chemically synthesized
ctgttccttgttataaactgga

SEQ ID NO: 1396812 - DNA, 22 bp, Artificial Sequence
  chemically synthesized
atcttgcagtttccagtttata

SEQ ID NO: 1396813 - DNA, 22 bp, Artificial Sequence
  chemically synthesized
gcagtttccagtttataacaag

SEQ ID NO: 1396814 - DNA, 22 bp, Artificial Sequence
  chemically synthesized
cagtttccagtttataacaagg

SEQ ID NO: 1396815 - DNA, 22 bp, Artificial Sequence
  chemically synthesized
ccagtttataacaaggaacaga

SEQ ID NO: 1396816 - DNA, 22 bp, Artificial Sequence
  chemically synthesized
cagtttataacaaggaacagaa

SEQ ID NO: 1396817 - DNA, 22 bp, Artificial Sequence
  chemically synthesized
aatcatgtatatttctgttcct

SEQ ID NO: 1396818 - DNA, 22 bp, Artificial Sequence
  chemically synthesized
tattaaatcatgtatatttctg

SEQ ID NO: 1396819 - DNA, 22 bp, Artificial Sequence
  chemically synthesized
ataacaaggaacagaaatatac

SEQ ID NO: 1396820 - DNA, 22 bp, Artificial Sequence
  chemically synthesized
taacaaggaacagaaatataca

SEQ ID NO: 1396821 - DNA, 22 bp, Artificial Sequence
  chemically synthesized
tgaccatacgttatattaaatc

SEQ ID NO: 1396822 - DNA, 22 bp, Artificial Sequence
  chemically synthesized
ctatgaccatacgttatattaa

SEQ ID NO: 1396823 - DNA, 22 bp, Artificial Sequence
  chemically synthesized
tactatgaccatacgttatatt

SEQ ID NO: 1396824 - DNA, 22 bp, Artificial Sequence
  chemically synthesized
agctctactatgaccatacgtt

SEQ ID NO: 1396825 - DNA, 22 bp, Artificial Sequence
  chemically synthesized
cagctctactatgaccatacgt

SEQ ID NO: 1396826 - DNA, 22 bp, Artificial Sequence
  chemically synthesized
tcagctctactatgaccatacg

SEQ ID NO: 1396827 - DNA, 22 bp, Artificial Sequence
  chemically synthesized
aatataacgtatggtcatagta

SEQ ID NO: 1396828 - DNA, 22 bp, Artificial Sequence
  chemically synthesized
atataacgtatggtcatagtag

SEQ ID NO: 1396829 - DNA, 22 bp, Artificial Sequence
  chemically synthesized
agattttcagctctactatgac

SEQ ID NO: 1396830 - DNA, 22 bp, Artificial Sequence
  chemically synthesized
cagattttcagctctactatga

SEQ ID NO: 1396831 - DNA, 22 bp, Artificial Sequence
  chemically synthesized
gccaaagcttcagattttcagc

SEQ ID NO: 1396832 - DNA, 22 bp, Artificial Sequence
  chemically synthesized
agccaaagcttcagattttcag

SEQ ID NO: 1396833 - DNA, 22 bp, Artificial Sequence
  chemically synthesized
tagccaaagcttcagattttca

SEQ ID NO: 1396834 - DNA, 22 bp, Artificial Sequence
  chemically synthesized
attttagccaaagcttcagatt

SEQ ID NO: 1396835 - DNA, 22 bp, Artificial Sequence
  chemically synthesized
ctcattttagccaaagcttcag

SEQ ID NO: 1396836 - DNA, 22 bp, Artificial Sequence
  chemically synthesized
cctcattttagccaaagcttca

SEQ ID NO: 1396837 - DNA, 22 bp, Artificial Sequence
  chemically synthesized
cttcctcattttagccaaagct

SEQ ID NO: 1396838 - DNA, 22 bp, Artificial Sequence
  chemically synthesized
aaaatctgaagctttggctaaa

SEQ ID NO: 1396839 - DNA, 22 bp, Artificial Sequence
  chemically synthesized
ggtactccttcctcattttagc

SEQ ID NO: 1396840 - DNA, 22 bp, Artificial Sequence
  chemically synthesized
aggtactccttcctcattttag

SEQ ID NO: 1396841 - DNA, 22 bp, Artificial Sequence
  chemically synthesized
aagctttggctaaaatgaggaa

SEQ ID NO: 1396842 - DNA, 22 bp, Artificial Sequence
  chemically synthesized
tggctaaaatgaggaaggagta

SEQ ID NO: 1396843 - DNA, 22 bp, Artificial Sequence
  chemically synthesized
ggctaaaatgaggaaggagtac

SEQ ID NO: 1396844 - DNA, 22 bp, Artificial Sequence
  chemically synthesized
gctaaaatgaggaaggagtacc

SEQ ID NO: 1396845 - DNA, 22 bp, Artificial Sequence
  chemically synthesized
aaatgaggaaggagtacctaaa

SEQ ID NO: 1396846 - DNA, 22 bp, Artificial Sequence
  chemically synthesized
gcaaataccaggcccatttagg

SEQ ID NO: 1396847 - DNA, 22 bp, Artificial Sequence
  chemically synthesized
agcaaataccaggcccatttag

SEQ ID NO: 1396848 - DNA, 22 bp, Artificial Sequence
  chemically synthesized
tacatttagcaaataccaggcc

SEQ ID NO: 1396849 - DNA, 22 bp, Artificial Sequence
  chemically synthesized
tatacatttagcaaataccagg

SEQ ID NO: 1396850 - DNA, 22 bp, Artificial Sequence
  chemically synthesized
cctctatacatttagcaaatac

SEQ ID NO: 1396851 - DNA, 22 bp, Artificial Sequence
  chemically synthesized
aatgggcctggtatttgctaaa

SEQ ID NO: 1396852 - DNA, 22 bp, Artificial Sequence
  chemically synthesized
ttccctctatacatttagcaaa

SEQ ID NO: 1396853 - DNA, 22 bp, Artificial Sequence
  chemically synthesized
aatgttgttccctctatacatt

SEQ ID NO: 1396854 - DNA, 22 bp, Artificial Sequence
  chemically synthesized
gtatttgctaaatgtatagagg

SEQ ID NO: 1396855 - DNA, 22 bp, Artificial Sequence
  chemically synthesized
aattaaatgttgttccctctat

SEQ ID NO: 1396856 - DNA, 22 bp, Artificial Sequence
  chemically synthesized
gctaaatgtatagagggaacaa

SEQ ID NO: 1396857 - DNA, 22 bp, Artificial Sequence
  chemically synthesized
ctcaattaaatgttgttccctc

SEQ ID NO: 1396858 - DNA, 22 bp, Artificial Sequence
  chemically synthesized
ctaaatgtatagagggaacaac

SEQ ID NO: 1396859 - DNA, 22 bp, Artificial Sequence
  chemically synthesized
cctcaattaaatgttgttccct

SEQ ID NO: 1396860 - DNA, 22 bp, Artificial Sequence
  chemically synthesized
aatgtatagagggaacaacatt

SEQ ID NO: 1396861 - DNA, 22 bp, Artificial Sequence
  chemically synthesized
tttcctcaattaaatgttgttc

SEQ ID NO: 1396862 - DNA, 22 bp, Artificial Sequence
  chemically synthesized
atttcctcaattaaatgttgtt

SEQ ID NO: 1396863 - DNA, 22 bp, Artificial Sequence
  chemically synthesized
cttatttcctcaattaaatgtt

SEQ ID NO: 1396864 - DNA, 22 bp, Artificial Sequence
  chemically synthesized
ctacttatttcctcaattaaat

SEQ ID NO: 1396865 - DNA, 22 bp, Artificial Sequence
  chemically synthesized
tcagtggaaatctcctacttat

SEQ ID NO: 1396866 - DNA, 22 bp, Artificial Sequence
  chemically synthesized
aattgaggaaataagtaggaga

SEQ ID NO: 1396867 - DNA, 22 bp, Artificial Sequence
  chemically synthesized
tatcagtggaaatctcctactt

SEQ ID NO: 1396868 - DNA, 22 bp, Artificial Sequence
  chemically synthesized
attgaggaaataagtaggagat

SEQ ID NO: 1396869 - DNA, 22 bp, Artificial Sequence
  chemically synthesized
aggaaataagtaggagatttcc

SEQ ID NO: 1396870 - DNA, 22 bp, Artificial Sequence
  chemically synthesized
ccattctatcagtggaaatctc

SEQ ID NO: 1396871 - DNA, 22 bp, Artificial Sequence
  chemically synthesized
taccattctatcagtggaaatc

SEQ ID NO: 1396872 - DNA, 22 bp, Artificial Sequence
  chemically synthesized
ctaccattctatcagtggaaat

SEQ ID NO: 1396873 - DNA, 22 bp, Artificial Sequence
  chemically synthesized
cttctaccattctatcagtgga

SEQ ID NO: 1396874 - DNA, 22 bp, Artificial Sequence
  chemically synthesized
ccactgatagaatggtagaagt

SEQ ID NO: 1396875 - DNA, 22 bp, Artificial Sequence
  chemically synthesized
cactgatagaatggtagaagta

SEQ ID NO: 1396876 - DNA, 22 bp, Artificial Sequence
  chemically synthesized
atagaatggtagaagtagggct

SEQ ID NO: 1396877 - DNA, 22 bp, Artificial Sequence
  chemically synthesized
catgtcccccacacccatcaca

SEQ ID NO: 1396878 - DNA, 22 bp, Artificial Sequence
  chemically synthesized
ccctccatgtcccccacaccca

SEQ ID NO: 1396879 - DNA, 22 bp, Artificial Sequence
  chemically synthesized
cccctccatgtcccccacaccc

SEQ ID NO: 1396880 - DNA, 22 bp, Artificial Sequence
  chemically synthesized
tcccctccatgtcccccacacc

SEQ ID NO: 1396881 - DNA, 22 bp, Artificial Sequence
  chemically synthesized
cctttcccctccatgtccccca

SEQ ID NO: 1396882 - DNA, 22 bp, Artificial Sequence
  chemically synthesized
gcctttcccctccatgtccccc

SEQ ID NO: 1396883 - DNA, 22 bp, Artificial Sequence
  chemically synthesized
tgatgggtgtgggggacatgga

SEQ ID NO: 1396884 - DNA, 22 bp, Artificial Sequence
  chemically synthesized
tgccatttgcctttcccctcca

SEQ ID NO: 1396885 - DNA, 22 bp, Artificial Sequence
  chemically synthesized
tgtgccatttgcctttcccctc

SEQ ID NO: 1396886 - DNA, 22 bp, Artificial Sequence
  chemically synthesized
aagcctctgtgccatttgcctt

SEQ ID NO: 1396887 - DNA, 22 bp, Artificial Sequence
  chemically synthesized
caagcctctgtgccatttgcct

SEQ ID NO: 1396888 - DNA, 22 bp, Artificial Sequence
  chemically synthesized
tcaagcctctgtgccatttgcc

SEQ ID NO: 1396889 - DNA, 22 bp, Artificial Sequence
  chemically synthesized
acccaaacatgccaggagtttt

SEQ ID NO: 1396890 - DNA, 22 bp, Artificial Sequence
  chemically synthesized
tcacccaaacatgccaggagtt

SEQ ID NO: 1396891 - DNA, 22 bp, Artificial Sequence
  chemically synthesized
acctctcacccaaacatgccag

SEQ ID NO: 1396892 - DNA, 22 bp, Artificial Sequence
  chemically synthesized
tcacctctcacccaaacatgcc

SEQ ID NO: 1396893 - DNA, 22 bp, Artificial Sequence
  chemically synthesized
gaaaactcctggcatgtttggg

SEQ ID NO: 1396894 - DNA, 22 bp, Artificial Sequence
  chemically synthesized
aaaactcctggcatgtttgggt

SEQ ID NO: 1396895 - DNA, 22 bp, Artificial Sequence
  chemically synthesized
ctggcatgtttgggtgagaggt

SEQ ID NO: 1396896 - DNA, 22 bp, Artificial Sequence
  chemically synthesized
gcatgtttgggtgagaggtgag

SEQ ID NO: 1396897 - DNA, 22 bp, Artificial Sequence
  chemically synthesized
gggtgagaggtgagagattcta

SEQ ID NO: 1396898 - DNA, 22 bp, Artificial Sequence
  chemically synthesized
ggtgagaggtgagagattctat

SEQ ID NO: 1396899 - DNA, 22 bp, Artificial Sequence
  chemically synthesized
tgatgtagccacatagaatctc

SEQ ID NO: 1396900 - DNA, 22 bp, Artificial Sequence
  chemically synthesized
ctgtgatgtagccacatagaat

SEQ ID NO: 1396901 - DNA, 22 bp, Artificial Sequence
  chemically synthesized
tattgctgtgatgtagccacat

SEQ ID NO: 1396902 - DNA, 22 bp, Artificial Sequence
  chemically synthesized
atattgctgtgatgtagccaca

SEQ ID NO: 1396903 - DNA, 22 bp, Artificial Sequence
  chemically synthesized
tatgtggctacatcacagcaat

SEQ ID NO: 1396904 - DNA, 22 bp, Artificial Sequence
  chemically synthesized
tgtggctacatcacagcaatat

SEQ ID NO: 1396905 - DNA, 22 bp, Artificial Sequence
  chemically synthesized
caacatgacatttatattgctg

SEQ ID NO: 1396906 - DNA, 22 bp, Artificial Sequence
  chemically synthesized
ccaacatgacatttatattgct

SEQ ID NO: 1396907 - DNA, 22 bp, Artificial Sequence
  chemically synthesized
tccaacatgacatttatattgc

SEQ ID NO: 1396908 - DNA, 22 bp, Artificial Sequence
  chemically synthesized
actttccaacatgacatttata

SEQ ID NO: 1396909 - DNA, 22 bp, Artificial Sequence
  chemically synthesized
catcacagcaatataaatgtca

SEQ ID NO: 1396910 - DNA, 22 bp, Artificial Sequence
  chemically synthesized
cagactcactttccaacatgac

SEQ ID NO: 1396911 - DNA, 22 bp, Artificial Sequence
  chemically synthesized
tccagactcactttccaacatg

SEQ ID NO: 1396912 - DNA, 22 bp, Artificial Sequence
  chemically synthesized
ctccagactcactttccaacat

SEQ ID NO: 1396913 - DNA, 22 bp, Artificial Sequence
  chemically synthesized
ttctccagactcactttccaac

SEQ ID NO: 1396914 - DNA, 22 bp, Artificial Sequence
  chemically synthesized
cttctccagactcactttccaa

SEQ ID NO: 1396915 - DNA, 22 bp, Artificial Sequence
  chemically synthesized
tcttctccagactcactttcca

SEQ ID NO: 1396916 - DNA, 22 bp, Artificial Sequence
  chemically synthesized
ccccaattttcttctccagact

SEQ ID NO: 1396917 - DNA, 22 bp, Artificial Sequence
  chemically synthesized
gccccaattttcttctccagac

SEQ ID NO: 1396918 - DNA, 22 bp, Artificial Sequence
  chemically synthesized
tttgccccaattttcttctcca

SEQ ID NO: 1396919 - DNA, 22 bp, Artificial Sequence
  chemically synthesized
gaaagtgagtctggagaagaaa

SEQ ID NO: 1396920 - DNA, 22 bp, Artificial Sequence
  chemically synthesized
gattgtttgccccaattttctt

SEQ ID NO: 1396921 - DNA, 22 bp, Artificial Sequence
  chemically synthesized
ggattgtttgccccaattttct

SEQ ID NO: 1396922 - DNA, 22 bp, Artificial Sequence
  chemically synthesized
tggattgtttgccccaattttc

SEQ ID NO: 1396923 - DNA, 22 bp, Artificial Sequence
  chemically synthesized
agactttggattgtttgcccca

SEQ ID NO: 1396924 - DNA, 22 bp, Artificial Sequence
  chemically synthesized
gagaagaaaattggggcaaaca

SEQ ID NO: 1396925 - DNA, 22 bp, Artificial Sequence
  chemically synthesized
attgagactttggattgtttgc

SEQ ID NO: 1396926 - DNA, 22 bp, Artificial Sequence
  chemically synthesized
tactaattgagactttggattg

SEQ ID NO: 1396927 - DNA, 22 bp, Artificial Sequence
  chemically synthesized
gtactaattgagactttggatt

SEQ ID NO: 1396928 - DNA, 22 bp, Artificial Sequence
  chemically synthesized
tgtactaattgagactttggat

SEQ ID NO: 1396929 - DNA, 22 bp, Artificial Sequence
  chemically synthesized
gggcaaacaatccaaagtctca

SEQ ID NO: 1396930 - DNA, 22 bp, Artificial Sequence
  chemically synthesized
ggtccccatggctttgtactaa

SEQ ID NO: 1396931 - DNA, 22 bp, Artificial Sequence
  chemically synthesized
aattagtacaaagccatgggga

SEQ ID NO: 1396932 - DNA, 22 bp, Artificial Sequence
  chemically synthesized
gtacaaagccatggggacccag

SEQ ID NO: 1396933 - DNA, 22 bp, Artificial Sequence
  chemically synthesized
cagagacagagtctgggtcccc

SEQ ID NO: 1396934 - DNA, 22 bp, Artificial Sequence
  chemically synthesized
agtattacagagacagagtctg

SEQ ID NO: 1396935 - DNA, 22 bp, Artificial Sequence
  chemically synthesized
tcctcagtattacagagacaga

SEQ ID NO: 1396936 - DNA, 22 bp, Artificial Sequence
  chemically synthesized
catctgtcctcagtattacaga

SEQ ID NO: 1396937 - DNA, 22 bp, Artificial Sequence
  chemically synthesized
tgctgcatctgtcctcagtatt

SEQ ID NO: 1396938 - DNA, 22 bp, Artificial Sequence
  chemically synthesized
tatgctgcatctgtcctcagta

SEQ ID NO: 1396939 - DNA, 22 bp, Artificial Sequence
  chemically synthesized
tgtctctgtaatactgaggaca

SEQ ID NO: 1396940 - DNA, 22 bp, Artificial Sequence
  chemically synthesized
tctctgtaatactgaggacaga

SEQ ID NO: 1396941 - DNA, 22 bp, Artificial Sequence
  chemically synthesized
ctctatgctgcatctgtcctca

SEQ ID NO: 1396942 - DNA, 22 bp, Artificial Sequence
  chemically synthesized
tgtaatactgaggacagatgca

SEQ ID NO: 1396943 - DNA, 22 bp, Artificial Sequence
  chemically synthesized
taatactgaggacagatgcagc

SEQ ID NO: 1396944 - DNA, 22 bp, Artificial Sequence
  chemically synthesized
taatatctactctatgctgcat

SEQ ID NO: 1396945 - DNA, 22 bp, Artificial Sequence
  chemically synthesized
ttgtaatatctactctatgctg

SEQ ID NO: 1396946 - DNA, 22 bp, Artificial Sequence
  chemically synthesized
gttgtaatatctactctatgct

SEQ ID NO: 1396947 - DNA, 22 bp, Artificial Sequence
  chemically synthesized
aggacagatgcagcatagagta

SEQ ID NO: 1396948 - DNA, 22 bp, Artificial Sequence
  chemically synthesized
ggcagggtagcgccatagtatc

SEQ ID NO: 1396949 - DNA, 22 bp, Artificial Sequence
  chemically synthesized
aggcagggtagcgccatagtat

SEQ ID NO: 1396950 - DNA, 22 bp, Artificial Sequence
  chemically synthesized
caacaagatactatggcgctac

SEQ ID NO: 1396951 - DNA, 22 bp, Artificial Sequence
  chemically synthesized
aaacttaggcagggtagcgcca

SEQ ID NO: 1396952 - DNA, 22 bp, Artificial Sequence
  chemically synthesized
agagcacattgaaacttaggca

SEQ ID NO: 1396953 - DNA, 22 bp, Artificial Sequence
  chemically synthesized
tggcgctaccctgcctaagttt

SEQ ID NO: 1396954 - DNA, 22 bp, Artificial Sequence
  chemically synthesized
gagagcacattgaaacttaggc

SEQ ID NO: 1396955 - DNA, 22 bp, Artificial Sequence
  chemically synthesized
tttgagagcacattgaaactta

SEQ ID NO: 1396956 - DNA, 22 bp, Artificial Sequence
  chemically synthesized
ccctgcctaagtttcaatgtgc

SEQ ID NO: 1396957 - DNA, 22 bp, Artificial Sequence
  chemically synthesized
cctaagtttcaatgtgctctca

SEQ ID NO: 1396958 - DNA, 22 bp, Artificial Sequence
  chemically synthesized
agtttcaatgtgctctcaaata

SEQ ID NO: 1396959 - DNA, 22 bp, Artificial Sequence
  chemically synthesized
tccaaagtcaccaactatttga

SEQ ID NO: 1396960 - DNA, 22 bp, Artificial Sequence
  chemically synthesized
gtccaaagtcaccaactatttg

SEQ ID NO: 1396961 - DNA, 22 bp, Artificial Sequence
  chemically synthesized
caatgtgctctcaaatagttgg

SEQ ID NO: 1396962 - DNA, 22 bp, Artificial Sequence
  chemically synthesized
aatgtgctctcaaatagttggt

SEQ ID NO: 1396963 - DNA, 22 bp, Artificial Sequence
  chemically synthesized
tcaaatagttggtgactttgga

SEQ ID NO: 1396964 - DNA, 22 bp, Artificial Sequence
  chemically synthesized
aaatagttggtgactttggaca

SEQ ID NO: 1396965 - DNA, 22 bp, Artificial Sequence
  chemically synthesized
gtgactttggacaagttgttta

SEQ ID NO: 1396966 - DNA, 22 bp, Artificial Sequence
  chemically synthesized
gtcagggtggggataaacaact

SEQ ID NO: 1396967 - DNA, 22 bp, Artificial Sequence
  chemically synthesized
tggacaagttgtttatccccac

SEQ ID NO: 1396968 - DNA, 22 bp, Artificial Sequence
  chemically synthesized
ggacaagttgtttatccccacc

SEQ ID NO: 1396969 - DNA, 22 bp, Artificial Sequence
  chemically synthesized
gacaagttgtttatccccaccc

SEQ ID NO: 1396970 - DNA, 22 bp, Artificial Sequence
  chemically synthesized
tttatccccaccctgactaata

SEQ ID NO: 1396971 - DNA, 22 bp, Artificial Sequence
  chemically synthesized
aggcatagagcatgtattagtc

SEQ ID NO: 1396972 - DNA, 22 bp, Artificial Sequence
  chemically synthesized
atccccaccctgactaatacat

SEQ ID NO: 1396973 - DNA, 22 bp, Artificial Sequence
  chemically synthesized
tccccaccctgactaatacatg

SEQ ID NO: 1396974 - DNA, 22 bp, Artificial Sequence
  chemically synthesized
actaatacatgctctatgcctc

SEQ ID NO: 1396975 - DNA, 22 bp, Artificial Sequence
  chemically synthesized
cagataagtaaactgaggcata

SEQ ID NO: 1396976 - DNA, 22 bp, Artificial Sequence
  chemically synthesized
gcagataagtaaactgaggcat

SEQ ID NO: 1396977 - DNA, 22 bp, Artificial Sequence
  chemically synthesized
atacatgctctatgcctcagtt

SEQ ID NO: 1396978 - DNA, 22 bp, Artificial Sequence
  chemically synthesized
tgcagataagtaaactgaggca

SEQ ID NO: 1396979 - DNA, 22 bp, Artificial Sequence
  chemically synthesized
attttgcagataagtaaactga

SEQ ID NO: 1396980 - DNA, 22 bp, Artificial Sequence
  chemically synthesized
tatgcctcagtttacttatctg

SEQ ID NO: 1396981 - DNA, 22 bp, Artificial Sequence
  chemically synthesized
tgcctcagtttacttatctgca

SEQ ID NO: 1396982 - DNA, 22 bp, Artificial Sequence
  chemically synthesized
atatcctcattttgcagataag

SEQ ID NO: 1396983 - DNA, 22 bp, Artificial Sequence
  chemically synthesized
agtttacttatctgcaaaatga

SEQ ID NO: 1396984 - DNA, 22 bp, Artificial Sequence
  chemically synthesized
aatattaatatcctcattttgc

SEQ ID NO: 1396985 - DNA, 22 bp, Artificial Sequence
  chemically synthesized
acttatctgcaaaatgaggata

SEQ ID NO: 1396986 - DNA, 22 bp, Artificial Sequence
  chemically synthesized
cttatctgcaaaatgaggatat

SEQ ID NO: 1396987 - DNA, 22 bp, Artificial Sequence
  chemically synthesized
atctgcaaaatgaggatattaa

SEQ ID NO: 1396988 - DNA, 22 bp, Artificial Sequence
  chemically synthesized
tctgcaaaatgaggatattaat

SEQ ID NO: 1396989 - DNA, 22 bp, Artificial Sequence
  chemically synthesized
caaaatgaggatattaatattt

SEQ ID NO: 1396990 - DNA, 22 bp, Artificial Sequence
  chemically synthesized
aaaacaatccaatgagctaaat

SEQ ID NO: 1396991 - DNA, 22 bp, Artificial Sequence
  chemically synthesized
ctcaaaacaatccaatgagcta

SEQ ID NO: 1396992 - DNA, 22 bp, Artificial Sequence
  chemically synthesized
atatttagctcattggattgtt

SEQ ID NO: 1396993 - DNA, 22 bp, Artificial Sequence
  chemically synthesized
tccaatactcctcaaaacaatc

SEQ ID NO: 1396994 - DNA, 22 bp, Artificial Sequence
  chemically synthesized
gtccaatactcctcaaaacaat

SEQ ID NO: 1396995 - DNA, 22 bp, Artificial Sequence
  chemically synthesized
tgtccaatactcctcaaaacaa

SEQ ID NO: 1396996 - DNA, 22 bp, Artificial Sequence
  chemically synthesized
agctcattggattgttttgagg

SEQ ID NO: 1396997 - DNA, 22 bp, Artificial Sequence
  chemically synthesized
gctcattggattgttttgagga

SEQ ID NO: 1396998 - DNA, 22 bp, Artificial Sequence
  chemically synthesized
attggattgttttgaggagtat

SEQ ID NO: 1396999 - DNA, 22 bp, Artificial Sequence
  chemically synthesized
aaagaattttgtccaatactcc

SEQ ID NO: 1397000 - DNA, 22 bp, Artificial Sequence
  chemically synthesized
gattgttttgaggagtattgga

SEQ ID NO: 1397001 - DNA, 22 bp, Artificial Sequence
  chemically synthesized
aaaagaattttgtccaatactc

SEQ ID NO: 1397002 - DNA, 22 bp, Artificial Sequence
  chemically synthesized
taaaagaattttgtccaatact

SEQ ID NO: 1397003 - DNA, 22 bp, Artificial Sequence
  chemically synthesized
ttttgaggagtattggacaaaa

SEQ ID NO: 1397004 - DNA, 22 bp, Artificial Sequence
  chemically synthesized
tgaggagtattggacaaaattc

SEQ ID NO: 1397005 - DNA, 22 bp, Artificial Sequence
  chemically synthesized
catactttaaaagaattttgtc

SEQ ID NO: 1397006 - DNA, 22 bp, Artificial Sequence
  chemically synthesized
gaggagtattggacaaaattct

SEQ ID NO: 1397007 - DNA, 22 bp, Artificial Sequence
  chemically synthesized
acatactttaaaagaattttgt

SEQ ID NO: 1397008 - DNA, 22 bp, Artificial Sequence
  chemically synthesized
aggagtattggacaaaattctt

SEQ ID NO: 1397009 - DNA, 22 bp, Artificial Sequence
  chemically synthesized
tacatactttaaaagaattttg

SEQ ID NO: 1397010 - DNA, 22 bp, Artificial Sequence
  chemically synthesized
gacaaaattcttttaaagtatg

SEQ ID NO: 1397011 - DNA, 22 bp, Artificial Sequence
  chemically synthesized
aaaggatataattttacatact

SEQ ID NO: 1397012 - DNA, 22 bp, Artificial Sequence
  chemically synthesized
ttaaaaggatataattttacat

SEQ ID NO: 1397013 - DNA, 22 bp, Artificial Sequence
  chemically synthesized
ttttaaagtatgtaaaattata

SEQ ID NO: 1397014 - DNA, 22 bp, Artificial Sequence
  chemically synthesized
ttattaaaaggatataatttta

SEQ ID NO: 1397015 - DNA, 22 bp, Artificial Sequence
  chemically synthesized
ttaaagtatgtaaaattatatc

SEQ ID NO: 1397016 - DNA, 22 bp, Artificial Sequence
  chemically synthesized
taaagtatgtaaaattatatcc

SEQ ID NO: 1397017 - DNA, 22 bp, Artificial Sequence
  chemically synthesized
aaagtatgtaaaattatatcct

SEQ ID NO: 1397018 - DNA, 22 bp, Artificial Sequence
  chemically synthesized
aagtatgtaaaattatatcctt

SEQ ID NO: 1397019 - DNA, 22 bp, Artificial Sequence
  chemically synthesized
atcaatgttgttattaaaagga

SEQ ID NO: 1397020 - DNA, 22 bp, Artificial Sequence
  chemically synthesized
aatcaatgttgttattaaaagg

SEQ ID NO: 1397021 - DNA, 22 bp, Artificial Sequence
  chemically synthesized
tttaatcaatgttgttattaaa

SEQ ID NO: 1397022 - DNA, 22 bp, Artificial Sequence
  chemically synthesized
tatccttttaataacaacattg

SEQ ID NO: 1397023 - DNA, 22 bp, Artificial Sequence
  chemically synthesized
gaatctatttaatcaatgttgt

SEQ ID NO: 1397024 - DNA, 22 bp, Artificial Sequence
  chemically synthesized
ggaatctatttaatcaatgttg

SEQ ID NO: 1397025 - DNA, 22 bp, Artificial Sequence
  chemically synthesized
ttaataacaacattgattaaat

SEQ ID NO: 1397026 - DNA, 22 bp, Artificial Sequence
  chemically synthesized
taataacaacattgattaaata

SEQ ID NO: 1397027 - DNA, 22 bp, Artificial Sequence
  chemically synthesized
aataacaacattgattaaatag

SEQ ID NO: 1397028 - DNA, 22 bp, Artificial Sequence
  chemically synthesized
ataacaacattgattaaataga

SEQ ID NO: 1397029 - DNA, 22 bp, Artificial Sequence
  chemically synthesized
caatacatacttggaatctatt

SEQ ID NO: 1397030 - DNA, 22 bp, Artificial Sequence
  chemically synthesized
ctccaatacatacttggaatct

SEQ ID NO: 1397031 - DNA, 22 bp, Artificial Sequence
  chemically synthesized
tgctccaatacatacttggaat

SEQ ID NO: 1397032 - DNA, 22 bp, Artificial Sequence
  chemically synthesized
tctgctccaatacatacttgga

SEQ ID NO: 1397033 - DNA, 22 bp, Artificial Sequence
  chemically synthesized
attaaatagattccaagtatgt

SEQ ID NO: 1397034 - DNA, 22 bp, Artificial Sequence
  chemically synthesized
tctctgctccaatacatacttg

SEQ ID NO: 1397035 - DNA, 22 bp, Artificial Sequence
  chemically synthesized
aatagattccaagtatgtattg

SEQ ID NO: 1397036 - DNA, 22 bp, Artificial Sequence
  chemically synthesized
gactctctctgctccaatacat

SEQ ID NO: 1397037 - DNA, 22 bp, Artificial Sequence
  chemically synthesized
caagtatgtattggagcagaga

SEQ ID NO: 1397038 - DNA, 22 bp, Artificial Sequence
  chemically synthesized
agggatcatcatctggactctc

SEQ ID NO: 1397039 - DNA, 22 bp, Artificial Sequence
  chemically synthesized
cagggatcatcatctggactct

SEQ ID NO: 1397040 - DNA, 22 bp, Artificial Sequence
  chemically synthesized
gagcagagagagtccagatgat

SEQ ID NO: 1397041 - DNA, 22 bp, Artificial Sequence
  chemically synthesized
gatttcagggatcatcatctgg

SEQ ID NO: 1397042 - DNA, 22 bp, Artificial Sequence
  chemically synthesized
ctggatttcagggatcatcatc

SEQ ID NO: 1397043 - DNA, 22 bp, Artificial Sequence
  chemically synthesized
gccactgctggatttcagggat

SEQ ID NO: 1397044 - DNA, 22 bp, Artificial Sequence
  chemically synthesized
ggccactgctggatttcaggga

SEQ ID NO: 1397045 - DNA, 22 bp, Artificial Sequence
  chemically synthesized
tggccactgctggatttcaggg

SEQ ID NO: 1397046 - DNA, 22 bp, Artificial Sequence
  chemically synthesized
ttggccactgctggatttcagg

SEQ ID NO: 1397047 - DNA, 22 bp, Artificial Sequence
  chemically synthesized
tttttggccactgctggatttc

SEQ ID NO: 1397048 - DNA, 22 bp, Artificial Sequence
  chemically synthesized
atttttggccactgctggattt

SEQ ID NO: 1397049 - DNA, 22 bp, Artificial Sequence
  chemically synthesized
tatttttggccactgctggatt

SEQ ID NO: 1397050 - DNA, 22 bp, Artificial Sequence
  chemically synthesized
ttatttttggccactgctggat

SEQ ID NO: 1397051 - DNA, 22 bp, Artificial Sequence
  chemically synthesized
ttttatttttggccactgctgg

SEQ ID NO: 1397052 - DNA, 22 bp, Artificial Sequence
  chemically synthesized
ctcttttatttttggccactgc

SEQ ID NO: 1397053 - DNA, 22 bp, Artificial Sequence
  chemically synthesized
tcctcttttatttttggccact

SEQ ID NO: 1397054 - DNA, 22 bp, Artificial Sequence
  chemically synthesized
tctcctcttttatttttggcca

SEQ ID NO: 1397055 - DNA, 22 bp, Artificial Sequence
  chemically synthesized
aaatccagcagtggccaaaaat

SEQ ID NO: 1397056 - DNA, 22 bp, Artificial Sequence
  chemically synthesized
ctctcctcttttatttttggcc

SEQ ID NO: 1397057 - DNA, 22 bp, Artificial Sequence
  chemically synthesized
ttctctcctcttttatttttgg

SEQ ID NO: 1397058 - DNA, 22 bp, Artificial Sequence
  chemically synthesized
caatgatcatgcattcttctct

SEQ ID NO: 1397059 - DNA, 22 bp, Artificial Sequence
  chemically synthesized
gagttgcaatgatcatgcattc

SEQ ID NO: 1397060 - DNA, 22 bp, Artificial Sequence
  chemically synthesized
tctcgagttgcaatgatcatgc

SEQ ID NO: 1397061 - DNA, 22 bp, Artificial Sequence
  chemically synthesized
aatctgtctcgagttgcaatga

SEQ ID NO: 1397062 - DNA, 22 bp, Artificial Sequence
  chemically synthesized
atagctaaatctgtctcgagtt

SEQ ID NO: 1397063 - DNA, 22 bp, Artificial Sequence
  chemically synthesized
taatagctaaatctgtctcgag

SEQ ID NO: 1397064 - DNA, 22 bp, Artificial Sequence
  chemically synthesized
ctaatagctaaatctgtctcga

SEQ ID NO: 1397065 - DNA, 22 bp, Artificial Sequence
  chemically synthesized
tctaatagctaaatctgtctcg

SEQ ID NO: 1397066 - DNA, 22 bp, Artificial Sequence
  chemically synthesized
caactcgagacagatttagcta

SEQ ID NO: 1397067 - DNA, 22 bp, Artificial Sequence
  chemically synthesized
gagacagatttagctattagaa

SEQ ID NO: 1397068 - DNA, 22 bp, Artificial Sequence
  chemically synthesized
ggtgtaatataagaaagaactt

SEQ ID NO: 1397069 - DNA, 22 bp, Artificial Sequence
  chemically synthesized
aggtgtaatataagaaagaact

SEQ ID NO: 1397070 - DNA, 22 bp, Artificial Sequence
  chemically synthesized
agctattagaaagttctttctt

SEQ ID NO: 1397071 - DNA, 22 bp, Artificial Sequence
  chemically synthesized
gctattagaaagttctttctta

SEQ ID NO: 1397072 - DNA, 22 bp, Artificial Sequence
  chemically synthesized
ttagaaagttctttcttatatt

SEQ ID NO: 1397073 - DNA, 22 bp, Artificial Sequence
  chemically synthesized
gaaagttctttcttatattaca

SEQ ID NO: 1397074 - DNA, 22 bp, Artificial Sequence
  chemically synthesized
tttcttatattacacctaaatt

SEQ ID NO: 1397075 - DNA, 22 bp, Artificial Sequence
  chemically synthesized
tcttatattacacctaaatttg

SEQ ID NO: 1397076 - DNA, 22 bp, Artificial Sequence
  chemically synthesized
catgaaggagagcaaatttagg

SEQ ID NO: 1397077 - DNA, 22 bp, Artificial Sequence
  chemically synthesized
cttatattacacctaaatttgc

SEQ ID NO: 1397078 - DNA, 22 bp, Artificial Sequence
  chemically synthesized
gcatgaaggagagcaaatttag

SEQ ID NO: 1397079 - DNA, 22 bp, Artificial Sequence
  chemically synthesized
ttatattacacctaaatttgct

SEQ ID NO: 1397080 - DNA, 22 bp, Artificial Sequence
  chemically synthesized
tgcatgaaggagagcaaattta

SEQ ID NO: 1397081 - DNA, 22 bp, Artificial Sequence
  chemically synthesized
atattacacctaaatttgctct

SEQ ID NO: 1397082 - DNA, 22 bp, Artificial Sequence
  chemically synthesized
tttgcatgaaggagagcaaatt

SEQ ID NO: 1397083 - DNA, 22 bp, Artificial Sequence
  chemically synthesized
tattacacctaaatttgctctc

SEQ ID NO: 1397084 - DNA, 22 bp, Artificial Sequence
  chemically synthesized
aattctttgcatgaaggagagc

SEQ ID NO: 1397085 - DNA, 22 bp, Artificial Sequence
  chemically synthesized
cacctaaatttgctctccttca

SEQ ID NO: 1397086 - DNA, 22 bp, Artificial Sequence
  chemically synthesized
aatttgctctccttcatgcaaa

SEQ ID NO: 1397087 - DNA, 22 bp, Artificial Sequence
  chemically synthesized
gctctccttcatgcaaagaatt

SEQ ID NO: 1397088 - DNA, 22 bp, Artificial Sequence
  chemically synthesized
ctctccttcatgcaaagaattc

SEQ ID NO: 1397089 - DNA, 22 bp, Artificial Sequence
  chemically synthesized
tccttcatgcaaagaattcaat

SEQ ID NO: 1397090 - DNA, 22 bp, Artificial Sequence
  chemically synthesized
cttcatgcaaagaattcaattt

SEQ ID NO: 1397091 - DNA, 22 bp, Artificial Sequence
  chemically synthesized
catgcaaagaattcaatttcta

SEQ ID NO: 1397092 - DNA, 22 bp, Artificial Sequence
  chemically synthesized
atgcaaagaattcaatttctac

SEQ ID NO: 1397093 - DNA, 22 bp, Artificial Sequence
  chemically synthesized
aatttctactggctggccctat

SEQ ID NO: 1397094 - DNA, 22 bp, Artificial Sequence
  chemically synthesized
ggtggaaggtagaaatagggcc

SEQ ID NO: 1397095 - DNA, 22 bp, Artificial Sequence
  chemically synthesized
ctactggctggccctatttcta

SEQ ID NO: 1397096 - DNA, 22 bp, Artificial Sequence
  chemically synthesized
ttaggtggaaggtagaaatagg

SEQ ID NO: 1397097 - DNA, 22 bp, Artificial Sequence
  chemically synthesized
tactggctggccctatttctac

SEQ ID NO: 1397098 - DNA, 22 bp, Artificial Sequence
  chemically synthesized
ctggctggccctatttctacct

SEQ ID NO: 1397099 - DNA, 22 bp, Artificial Sequence
  chemically synthesized
gctggccctatttctaccttcc

SEQ ID NO: 1397100 - DNA, 22 bp, Artificial Sequence
  chemically synthesized
gccctatttctaccttccacct

SEQ ID NO: 1397101 - DNA, 22 bp, Artificial Sequence
  chemically synthesized
tatgtaagtctattaggtggaa

SEQ ID NO: 1397102 - DNA, 22 bp, Artificial Sequence
  chemically synthesized
ttatatgtaagtctattaggtg

SEQ ID NO: 1397103 - DNA, 22 bp, Artificial Sequence
  chemically synthesized
tttctaccttccacctaataga

SEQ ID NO: 1397104 - DNA, 22 bp, Artificial Sequence
  chemically synthesized
attatatgtaagtctattaggt

SEQ ID NO: 1397105 - DNA, 22 bp, Artificial Sequence
  chemically synthesized
tattatatgtaagtctattagg

SEQ ID NO: 1397106 - DNA, 22 bp, Artificial Sequence
  chemically synthesized
ttattatatgtaagtctattag

SEQ ID NO: 1397107 - DNA, 22 bp, Artificial Sequence
  chemically synthesized
ctaccttccacctaatagactt

SEQ ID NO: 1397108 - DNA, 22 bp, Artificial Sequence
  chemically synthesized
taccttccacctaatagactta

SEQ ID NO: 1397109 - DNA, 22 bp, Artificial Sequence
  chemically synthesized
ccttccacctaatagacttaca

SEQ ID NO: 1397110 - DNA, 22 bp, Artificial Sequence
  chemically synthesized
aatttttattatatgtaagtct

SEQ ID NO: 1397111 - DNA, 22 bp, Artificial Sequence
  chemically synthesized
ccacctaatagacttacatata

SEQ ID NO: 1397112 - DNA, 22 bp, Artificial Sequence
  chemically synthesized
cacctaatagacttacatataa

SEQ ID NO: 1397113 - DNA, 22 bp, Artificial Sequence
  chemically synthesized
atagacttacatataataaaaa

SEQ ID NO: 1397114 - DNA, 22 bp, Artificial Sequence
  chemically synthesized
acatataataaaaattcagatg

SEQ ID NO: 1397115 - DNA, 22 bp, Artificial Sequence
  chemically synthesized
ggaaaaatataacatctgaatt

SEQ ID NO: 1397116 - DNA, 22 bp, Artificial Sequence
  chemically synthesized
catataataaaaattcagatgt

SEQ ID NO: 1397117 - DNA, 22 bp, Artificial Sequence
  chemically synthesized
aaaaagatataatctgggaaaa

SEQ ID NO: 1397118 - DNA, 22 bp, Artificial Sequence
  chemically synthesized
agatgttatatttttcccagat

SEQ ID NO: 1397119 - DNA, 22 bp, Artificial Sequence
  chemically synthesized
caaaattaaaaaagatataatc

SEQ ID NO: 1397120 - DNA, 22 bp, Artificial Sequence
  chemically synthesized
tatttttcccagattatatctt

SEQ ID NO: 1397121 - DNA, 22 bp, Artificial Sequence
  chemically synthesized
acaaaattaaaaaagatataat

SEQ ID NO: 1397122 - DNA, 22 bp, Artificial Sequence
  chemically synthesized
tacaaaattaaaaaagatataa

SEQ ID NO: 1397123 - DNA, 22 bp, Artificial Sequence
  chemically synthesized
ttacaaaattaaaaaagatata

SEQ ID NO: 1397124 - DNA, 22 bp, Artificial Sequence
  chemically synthesized
ttcccagattatatctttttta

SEQ ID NO: 1397125 - DNA, 22 bp, Artificial Sequence
  chemically synthesized
tttttacaaaattaaaaaagat

SEQ ID NO: 1397126 - DNA, 22 bp, Artificial Sequence
  chemically synthesized
tcccagattatatcttttttaa

SEQ ID NO: 1397127 - DNA, 22 bp, Artificial Sequence
  chemically synthesized
atttttacaaaattaaaaaaga

SEQ ID NO: 1397128 - DNA, 22 bp, Artificial Sequence
  chemically synthesized
cccagattatatcttttttaat

SEQ ID NO: 1397129 - DNA, 22 bp, Artificial Sequence
  chemically synthesized
ccagattatatcttttttaatt

SEQ ID NO: 1397130 - DNA, 22 bp, Artificial Sequence
  chemically synthesized
tttatttttacaaaattaaaaa

SEQ ID NO: 1397131 - DNA, 22 bp, Artificial Sequence
  chemically synthesized
atttatttttacaaaattaaaa

SEQ ID NO: 1397132 - DNA, 22 bp, Artificial Sequence
  chemically synthesized
tttatttatttttacaaaatta

SEQ ID NO: 1397133 - DNA, 22 bp, Artificial Sequence
  chemically synthesized
atttatttatttttacaaaatt

SEQ ID NO: 1397134 - DNA, 22 bp, Artificial Sequence
  chemically synthesized
tatcttttttaattttgtaaaa

SEQ ID NO: 1397135 - DNA, 22 bp, Artificial Sequence
  chemically synthesized
tttatttatttatttttacaaa

SEQ ID NO: 1397136 - DNA, 22 bp, Artificial Sequence
  chemically synthesized
atttatttatttatttttacaa

SEQ ID NO: 1397137 - DNA, 22 bp, Artificial Sequence
  chemically synthesized
tatttatttatttatttttaca

SEQ ID NO: 1397138 - DNA, 22 bp, Artificial Sequence
  chemically synthesized
ttatttatttatttatttttac

SEQ ID NO: 1397139 - DNA, 22 bp, Artificial Sequence
  chemically synthesized
ttttaattttgtaaaaataaat

SEQ ID NO: 1397140 - DNA, 22 bp, Artificial Sequence
  chemically synthesized
ttttatttatttatttattttt

SEQ ID NO: 1397141 - DNA, 22 bp, Artificial Sequence
  chemically synthesized
tttaattttgtaaaaataaata

SEQ ID NO: 1397142 - DNA, 22 bp, Artificial Sequence
  chemically synthesized
ttaattttgtaaaaataaataa

SEQ ID NO: 1397143 - DNA, 22 bp, Artificial Sequence
  chemically synthesized
taattttgtaaaaataaataaa

SEQ ID NO: 1397144 - DNA, 22 bp, Artificial Sequence
  chemically synthesized
aattttgtaaaaataaataaat

SEQ ID NO: 1397145 - DNA, 22 bp, Artificial Sequence
  chemically synthesized
attttgtaaaaataaataaata

SEQ ID NO: 1397146 - DNA, 22 bp, Artificial Sequence
  chemically synthesized
tgtaaaaataaataaataaata

SEQ ID NO: 1397147 - DNA, 22 bp, Artificial Sequence
  chemically synthesized
gtaaaaataaataaataaataa

SEQ ID NO: 1397148 - DNA, 22 bp, Artificial Sequence
  chemically synthesized
taaaaataaataaataaataaa

SEQ ID NO: 1397149 - DNA, 22 bp, Artificial Sequence
  chemically synthesized
gtgagtgaaatgtcaaactctt

SEQ ID NO: 1397150 - DNA, 22 bp, Artificial Sequence
  chemically synthesized
aggatgactcgtgagtgaaatg

SEQ ID NO: 1397151 - DNA, 22 bp, Artificial Sequence
  chemically synthesized
taaggatgactcgtgagtgaaa

SEQ ID NO: 1397152 - DNA, 22 bp, Artificial Sequence
  chemically synthesized
ctaaggatgactcgtgagtgaa

SEQ ID NO: 1397153 - DNA, 22 bp, Artificial Sequence
  chemically synthesized
tctaaggatgactcgtgagtga

SEQ ID NO: 1397154 - DNA, 22 bp, Artificial Sequence
  chemically synthesized
tttctaaggatgactcgtgagt

SEQ ID NO: 1397155 - DNA, 22 bp, Artificial Sequence
  chemically synthesized
ctctttctaaggatgactcgtg

SEQ ID NO: 1397156 - DNA, 22 bp, Artificial Sequence
  chemically synthesized
gacatttcactcacgagtcatc

SEQ ID NO: 1397157 - DNA, 22 bp, Artificial Sequence
  chemically synthesized
actctttctaaggatgactcgt

SEQ ID NO: 1397158 - DNA, 22 bp, Artificial Sequence
  chemically synthesized
acatttcactcacgagtcatcc

SEQ ID NO: 1397159 - DNA, 22 bp, Artificial Sequence
  chemically synthesized
tactctttctaaggatgactcg

SEQ ID NO: 1397160 - DNA, 22 bp, Artificial Sequence
  chemically synthesized
ttactctttctaaggatgactc

SEQ ID NO: 1397161 - DNA, 22 bp, Artificial Sequence
  chemically synthesized
cactcacgagtcatccttagaa

SEQ ID NO: 1397162 - DNA, 22 bp, Artificial Sequence
  chemically synthesized
atcttttactctttctaaggat

SEQ ID NO: 1397163 - DNA, 22 bp, Artificial Sequence
  chemically synthesized
actcacgagtcatccttagaaa

SEQ ID NO: 1397164 - DNA, 22 bp, Artificial Sequence
  chemically synthesized
tgatcttttactctttctaagg

SEQ ID NO: 1397165 - DNA, 22 bp, Artificial Sequence
  chemically synthesized
acgagtcatccttagaaagagt

SEQ ID NO: 1397166 - DNA, 22 bp, Artificial Sequence
  chemically synthesized
agaaagagtaaaagatcagagg

SEQ ID NO: 1397167 - DNA, 22 bp, Artificial Sequence
  chemically synthesized
gaaagagtaaaagatcagaggc

SEQ ID NO: 1397168 - DNA, 22 bp, Artificial Sequence
  chemically synthesized
caggcgtgagccaccgtgccca

SEQ ID NO: 1397169 - DNA, 22 bp, Artificial Sequence
  chemically synthesized
ggattacaggcgtgagccaccg

SEQ ID NO: 1397170 - DNA, 22 bp, Artificial Sequence
  chemically synthesized
tgggattacaggcgtgagccac

SEQ ID NO: 1397171 - DNA, 22 bp, Artificial Sequence
  chemically synthesized
ggcacggtggctcacgcctgta

SEQ ID NO: 1397172 - DNA, 22 bp, Artificial Sequence
  chemically synthesized
ccaaagttctgggattacaggc

SEQ ID NO: 1397173 - DNA, 22 bp, Artificial Sequence
  chemically synthesized
gcctcccaaagttctgggatta

SEQ ID NO: 1397174 - DNA, 22 bp, Artificial Sequence
  chemically synthesized
ggcctcccaaagttctgggatt

SEQ ID NO: 1397175 - DNA, 22 bp, Artificial Sequence
  chemically synthesized
acgcctgtaatcccagaacttt

SEQ ID NO: 1397176 - DNA, 22 bp, Artificial Sequence
  chemically synthesized
taatcccagaactttgggaggc

SEQ ID NO: 1397177 - DNA, 22 bp, Artificial Sequence
  chemically synthesized
aggtgatccgcccgccttggcc

SEQ ID NO: 1397178 - DNA, 22 bp, Artificial Sequence
  chemically synthesized
acctcaggtgatccgcccgcct

SEQ ID NO: 1397179 - DNA, 22 bp, Artificial Sequence
  chemically synthesized
tgggaggccaaggcgggcggat

SEQ ID NO: 1397180 - DNA, 22 bp, Artificial Sequence
  chemically synthesized
gggaggccaaggcgggcggatc

SEQ ID NO: 1397181 - DNA, 22 bp, Artificial Sequence
  chemically synthesized
ctgacctcaggtgatccgcccg

SEQ ID NO: 1397182 - DNA, 22 bp, Artificial Sequence
  chemically synthesized
ggaggccaaggcgggcggatca

SEQ ID NO: 1397183 - DNA, 22 bp, Artificial Sequence
  chemically synthesized
gaactcctgacctcaggtgatc

SEQ ID NO: 1397184 - DNA, 22 bp, Artificial Sequence
  chemically synthesized
gccaggatggtctcgaactcct

SEQ ID NO: 1397185 - DNA, 22 bp, Artificial Sequence
  chemically synthesized
tgttagccaggatggtctcgaa

SEQ ID NO: 1397186 - DNA, 22 bp, Artificial Sequence
  chemically synthesized
aggtcaggagttcgagaccatc

SEQ ID NO: 1397187 - DNA, 22 bp, Artificial Sequence
  chemically synthesized
actgtgttagccaggatggtct

SEQ ID NO: 1397188 - DNA, 22 bp, Artificial Sequence
  chemically synthesized
cactgtgttagccaggatggtc

SEQ ID NO: 1397189 - DNA, 22 bp, Artificial Sequence
  chemically synthesized
gagaccatcctggctaacacag

SEQ ID NO: 1397190 - DNA, 22 bp, Artificial Sequence
  chemically synthesized
gtagagacggggtttcactgtg

SEQ ID NO: 1397191 - DNA, 22 bp, Artificial Sequence
  chemically synthesized
agtagagacggggtttcactgt

SEQ ID NO: 1397192 - DNA, 22 bp, Artificial Sequence
  chemically synthesized
tagtagagacggggtttcactg

SEQ ID NO: 1397193 - DNA, 22 bp, Artificial Sequence
  chemically synthesized
ttagtagagacggggtttcact

SEQ ID NO: 1397194 - DNA, 22 bp, Artificial Sequence
  chemically synthesized
gctaacacagtgaaaccccgtc

SEQ ID NO: 1397195 - DNA, 22 bp, Artificial Sequence
  chemically synthesized
tatttttagtagagacggggtt

SEQ ID NO: 1397196 - DNA, 22 bp, Artificial Sequence
  chemically synthesized
gtatttttagtagagacggggt

SEQ ID NO: 1397197 - DNA, 22 bp, Artificial Sequence
  chemically synthesized
tgtatttttagtagagacgggg

SEQ ID NO: 1397198 - DNA, 22 bp, Artificial Sequence
  chemically synthesized
acacagtgaaaccccgtctcta

SEQ ID NO: 1397199 - DNA, 22 bp, Artificial Sequence
  chemically synthesized
ttgtatttttagtagagacggg

SEQ ID NO: 1397200 - DNA, 22 bp, Artificial Sequence
  chemically synthesized
tttgtatttttagtagagacgg

SEQ ID NO: 1397201 - DNA, 22 bp, Artificial Sequence
  chemically synthesized
attttttgtatttttagtagag

SEQ ID NO: 1397202 - DNA, 22 bp, Artificial Sequence
  chemically synthesized
tactaaaaatacaaaaaattag

SEQ ID NO: 1397203 - DNA, 22 bp, Artificial Sequence
  chemically synthesized
ctaaaaatacaaaaaattagct

SEQ ID NO: 1397204 - DNA, 22 bp, Artificial Sequence
  chemically synthesized
aaaatacaaaaaattagctggg

SEQ ID NO: 1397205 - DNA, 22 bp, Artificial Sequence
  chemically synthesized
caggcgtatgccacgacaccca

SEQ ID NO: 1397206 - DNA, 22 bp, Artificial Sequence
  chemically synthesized
ggactacaggcgtatgccacga

SEQ ID NO: 1397207 - DNA, 22 bp, Artificial Sequence
  chemically synthesized
gctgggtgtcgtggcatacgcc

SEQ ID NO: 1397208 - DNA, 22 bp, Artificial Sequence
  chemically synthesized
ggtgtcgtggcatacgcctgta

SEQ ID NO: 1397209 - DNA, 22 bp, Artificial Sequence
  chemically synthesized
ccaagtagctgggactacaggc

SEQ ID NO: 1397210 - DNA, 22 bp, Artificial Sequence
  chemically synthesized
agcctcccaagtagctgggact

SEQ ID NO: 1397211 - DNA, 22 bp, Artificial Sequence
  chemically synthesized
cctcagcctcccaagtagctgg

SEQ ID NO: 1397212 - DNA, 22 bp, Artificial Sequence
  chemically synthesized
ctgcctcagcctcccaagtagc

SEQ ID NO: 1397213 - DNA, 22 bp, Artificial Sequence
  chemically synthesized
tcctgcctcagcctcccaagta

SEQ ID NO: 1397214 - DNA, 22 bp, Artificial Sequence
  chemically synthesized
tagtcccagctacttgggaggc

SEQ ID NO: 1397215 - DNA, 22 bp, Artificial Sequence
  chemically synthesized
aagtgattctcctgcctcagcc

SEQ ID NO: 1397216 - DNA, 22 bp, Artificial Sequence
  chemically synthesized
cttgggaggctgaggcaggaga

SEQ ID NO: 1397217 - DNA, 22 bp, Artificial Sequence
  chemically synthesized
gggaggctgaggcaggagaatc

SEQ ID NO: 1397218 - DNA, 22 bp, Artificial Sequence
  chemically synthesized
ccgggttcaagtgattctcctg

SEQ ID NO: 1397219 - DNA, 22 bp, Artificial Sequence
  chemically synthesized
ggaggctgaggcaggagaatca

SEQ ID NO: 1397220 - DNA, 22 bp, Artificial Sequence
  chemically synthesized
cctcccgggttcaagtgattct

SEQ ID NO: 1397221 - DNA, 22 bp, Artificial Sequence
  chemically synthesized
tgcctcccgggttcaagtgatt

SEQ ID NO: 1397222 - DNA, 22 bp, Artificial Sequence
  chemically synthesized
ctgcctcccgggttcaagtgat

SEQ ID NO: 1397223 - DNA, 22 bp, Artificial Sequence
  chemically synthesized
aggcaggagaatcacttgaacc

SEQ ID NO: 1397224 - DNA, 22 bp, Artificial Sequence
  chemically synthesized
taacttctgcctcccgggttca

SEQ ID NO: 1397225 - DNA, 22 bp, Artificial Sequence
  chemically synthesized
actgtaacttctgcctcccggg

SEQ ID NO: 1397226 - DNA, 22 bp, Artificial Sequence
  chemically synthesized
gaacccgggaggcagaagttac

SEQ ID NO: 1397227 - DNA, 22 bp, Artificial Sequence
  chemically synthesized
aacccgggaggcagaagttaca

SEQ ID NO: 1397228 - DNA, 22 bp, Artificial Sequence
  chemically synthesized
cagtgagccatgcgccactgca

SEQ ID NO: 1397229 - DNA, 22 bp, Artificial Sequence
  chemically synthesized
tcacccaggccggagtgcagtg

SEQ ID NO: 1397230 - DNA, 22 bp, Artificial Sequence
  chemically synthesized
tgtcacccaggccggagtgcag

SEQ ID NO: 1397231 - DNA, 22 bp, Artificial Sequence
  chemically synthesized
gctctgtcacccaggccggagt

SEQ ID NO: 1397232 - DNA, 22 bp, Artificial Sequence
  chemically synthesized
cactccggcctgggtgacagag

SEQ ID NO: 1397233 - DNA, 22 bp, Artificial Sequence
  chemically synthesized
agatggagtctcgctctgtcac

SEQ ID NO: 1397234 - DNA, 22 bp, Artificial Sequence
  chemically synthesized
tgagatggagtctcgctctgtc

SEQ ID NO: 1397235 - DNA, 22 bp, Artificial Sequence
  chemically synthesized
ctgagatggagtctcgctctgt

SEQ ID NO: 1397236 - DNA, 22 bp, Artificial Sequence
  chemically synthesized
cggcctgggtgacagagcgaga

SEQ ID NO: 1397237 - DNA, 22 bp, Artificial Sequence
  chemically synthesized
tctgagatggagtctcgctctg

SEQ ID NO: 1397238 - DNA, 22 bp, Artificial Sequence
  chemically synthesized
ttctgagatggagtctcgctct

SEQ ID NO: 1397239 - DNA, 22 bp, Artificial Sequence
  chemically synthesized
tttctgagatggagtctcgctc

SEQ ID NO: 1397240 - DNA, 22 bp, Artificial Sequence
  chemically synthesized
ggtgacagagcgagactccatc

SEQ ID NO: 1397241 - DNA, 22 bp, Artificial Sequence
  chemically synthesized
tattttttctgagatggagtct

SEQ ID NO: 1397242 - DNA, 22 bp, Artificial Sequence
  chemically synthesized
atattttttctgagatggagtc

SEQ ID NO: 1397243 - DNA, 22 bp, Artificial Sequence
  chemically synthesized
tatatttatattttttctgaga

SEQ ID NO: 1397244 - DNA, 22 bp, Artificial Sequence
  chemically synthesized
tatatatttatattttttctga

SEQ ID NO: 1397245 - DNA, 22 bp, Artificial Sequence
  chemically synthesized
ctatatatttatattttttctg

SEQ ID NO: 1397246 - DNA, 22 bp, Artificial Sequence
  chemically synthesized
tttctatatatttatatttttt

SEQ ID NO: 1397247 - DNA, 22 bp, Artificial Sequence
  chemically synthesized
atttctatatatttatattttt

SEQ ID NO: 1397248 - DNA, 22 bp, Artificial Sequence
  chemically synthesized
tatttctatatatttatatttt

SEQ ID NO: 1397249 - DNA, 22 bp, Artificial Sequence
  chemically synthesized
catctcagaaaaaatataaata

SEQ ID NO: 1397250 - DNA, 22 bp, Artificial Sequence
  chemically synthesized
atctttatttctatatatttat

SEQ ID NO: 1397251 - DNA, 22 bp, Artificial Sequence
  chemically synthesized
tgatctttatttctatatattt

SEQ ID NO: 1397252 - DNA, 22 bp, Artificial Sequence
  chemically synthesized
agaaaaaatataaatatataga

SEQ ID NO: 1397253 - DNA, 22 bp, Artificial Sequence
  chemically synthesized
ctgatctttatttctatatatt

SEQ ID NO: 1397254 - DNA, 22 bp, Artificial Sequence
  chemically synthesized
tctgatctttatttctatatat

SEQ ID NO: 1397255 - DNA, 22 bp, Artificial Sequence
  chemically synthesized
caatgggcctttctgatcttta

SEQ ID NO: 1397256 - DNA, 22 bp, Artificial Sequence
  chemically synthesized
acaatgggcctttctgatcttt

SEQ ID NO: 1397257 - DNA, 22 bp, Artificial Sequence
  chemically synthesized
gtacttacaatgggcctttctg

SEQ ID NO: 1397258 - DNA, 22 bp, Artificial Sequence
  chemically synthesized
gaaccattagtacttacaatgg

SEQ ID NO: 1397259 - DNA, 22 bp, Artificial Sequence
  chemically synthesized
actggaaccattagtacttaca

SEQ ID NO: 1397260 - DNA, 22 bp, Artificial Sequence
  chemically synthesized
tatctcactggaaccattagta

SEQ ID NO: 1397261 - DNA, 22 bp, Artificial Sequence
  chemically synthesized
ctgtatctcactggaaccatta

SEQ ID NO: 1397262 - DNA, 22 bp, Artificial Sequence
  chemically synthesized
cctgctgtatctcactggaacc

SEQ ID NO: 1397263 - DNA, 22 bp, Artificial Sequence
  chemically synthesized
taagtactaatggttccagtga

SEQ ID NO: 1397264 - DNA, 22 bp, Artificial Sequence
  chemically synthesized
tgctgcctgctgtatctcactg

SEQ ID NO: 1397265 - DNA, 22 bp, Artificial Sequence
  chemically synthesized
ctgtgctgcctgctgtatctca

SEQ ID NO: 1397266 - DNA, 22 bp, Artificial Sequence
  chemically synthesized
actgtgctgcctgctgtatctc

SEQ ID NO: 1397267 - DNA, 22 bp, Artificial Sequence
  chemically synthesized
atggttccagtgagatacagca

SEQ ID NO: 1397268 - DNA, 22 bp, Artificial Sequence
  chemically synthesized
cttactgtgctgcctgctgtat

SEQ ID NO: 1397269 - DNA, 22 bp, Artificial Sequence
  chemically synthesized
cagtgagatacagcaggcagca

SEQ ID NO: 1397270 - DNA, 22 bp, Artificial Sequence
  chemically synthesized
acaatagaggcgctgcttactg

SEQ ID NO: 1397271 - DNA, 22 bp, Artificial Sequence
  chemically synthesized
ccctaacaatagaggcgctgct

SEQ ID NO: 1397272 - DNA, 22 bp, Artificial Sequence
  chemically synthesized
taccctaacaatagaggcgctg

SEQ ID NO: 1397273 - DNA, 22 bp, Artificial Sequence
  chemically synthesized
ctaccctaacaatagaggcgct

SEQ ID NO: 1397274 - DNA, 22 bp, Artificial Sequence
  chemically synthesized
tctaccctaacaatagaggcgc

SEQ ID NO: 1397275 - DNA, 22 bp, Artificial Sequence
  chemically synthesized
ctttctaccctaacaatagagg

SEQ ID NO: 1397276 - DNA, 22 bp, Artificial Sequence
  chemically synthesized
tgactgctttctaccctaacaa

SEQ ID NO: 1397277 - DNA, 22 bp, Artificial Sequence
  chemically synthesized
cctgtgactgctttctacccta

SEQ ID NO: 1397278 - DNA, 22 bp, Artificial Sequence
  chemically synthesized
tgcctgtgactgctttctaccc

SEQ ID NO: 1397279 - DNA, 22 bp, Artificial Sequence
  chemically synthesized
ctgcctgtgactgctttctacc

SEQ ID NO: 1397280 - DNA, 22 bp, Artificial Sequence
  chemically synthesized
tattgttagggtagaaagcagt

SEQ ID NO: 1397281 - DNA, 22 bp, Artificial Sequence
  chemically synthesized
ttgttagggtagaaagcagtca

SEQ ID NO: 1397282 - DNA, 22 bp, Artificial Sequence
  chemically synthesized
aatttctgcctgtgactgcttt

SEQ ID NO: 1397283 - DNA, 22 bp, Artificial Sequence
  chemically synthesized
ttagggtagaaagcagtcacag

SEQ ID NO: 1397284 - DNA, 22 bp, Artificial Sequence
  chemically synthesized
ttgaatttctgcctgtgactgc

SEQ ID NO: 1397285 - DNA, 22 bp, Artificial Sequence
  chemically synthesized
attgaatttctgcctgtgactg

SEQ ID NO: 1397286 - DNA, 22 bp, Artificial Sequence
  chemically synthesized
tattgaatttctgcctgtgact

SEQ ID NO: 1397287 - DNA, 22 bp, Artificial Sequence
  chemically synthesized
gggtagaaagcagtcacaggca

SEQ ID NO: 1397288 - DNA, 22 bp, Artificial Sequence
  chemically synthesized
ttattgaatttctgcctgtgac

SEQ ID NO: 1397289 - DNA, 22 bp, Artificial Sequence
  chemically synthesized
tttttattgaatttctgcctgt

SEQ ID NO: 1397290 - DNA, 22 bp, Artificial Sequence
  chemically synthesized
atttttattgaatttctgcctg

SEQ ID NO: 1397291 - DNA, 22 bp, Artificial Sequence
  chemically synthesized
ttatttttattgaatttctgcc

SEQ ID NO: 1397292 - DNA, 22 bp, Artificial Sequence
  chemically synthesized
cttatttttattgaatttctgc

SEQ ID NO: 1397293 - DNA, 22 bp, Artificial Sequence
  chemically synthesized
ttcttatttttattgaatttct

SEQ ID NO: 1397294 - DNA, 22 bp, Artificial Sequence
  chemically synthesized
cttcttatttttattgaatttc

SEQ ID NO: 1397295 - DNA, 22 bp, Artificial Sequence
  chemically synthesized
tcttcttatttttattgaattt

SEQ ID NO: 1397296 - DNA, 22 bp, Artificial Sequence
  chemically synthesized
ttcttcttatttttattgaatt

SEQ ID NO: 1397297 - DNA, 22 bp, Artificial Sequence
  chemically synthesized
aaatatttttcttcttattttt

SEQ ID NO: 1397298 - DNA, 22 bp, Artificial Sequence
  chemically synthesized
taaaatatttttcttcttattt

SEQ ID NO: 1397299 - DNA, 22 bp, Artificial Sequence
  chemically synthesized
aataaaaataagaagaaaaata

SEQ ID NO: 1397300 - DNA, 22 bp, Artificial Sequence
  chemically synthesized
gggactctaaaatatttttctt

SEQ ID NO: 1397301 - DNA, 22 bp, Artificial Sequence
  chemically synthesized
ggggactctaaaatatttttct

SEQ ID NO: 1397302 - DNA, 22 bp, Artificial Sequence
  chemically synthesized
aaggaggtaggatttggggact

SEQ ID NO: 1397303 - DNA, 22 bp, Artificial Sequence
  chemically synthesized
gaaggaggtaggatttggggac

SEQ ID NO: 1397304 - DNA, 22 bp, Artificial Sequence
  chemically synthesized
tgaaggaggtaggatttgggga

SEQ ID NO: 1397305 - DNA, 22 bp, Artificial Sequence
  chemically synthesized
ttgaaggaggtaggatttgggg

SEQ ID NO: 1397306 - DNA, 22 bp, Artificial Sequence
  chemically synthesized
tagagtccccaaatcctacctc

SEQ ID NO: 1397307 - DNA, 22 bp, Artificial Sequence
  chemically synthesized
agagtccccaaatcctacctcc

SEQ ID NO: 1397308 - DNA, 22 bp, Artificial Sequence
  chemically synthesized
gagtccccaaatcctacctcct

SEQ ID NO: 1397309 - DNA, 22 bp, Artificial Sequence
  chemically synthesized
gatgagtaacttttgaaggagg

SEQ ID NO: 1397310 - DNA, 22 bp, Artificial Sequence
  chemically synthesized
ggatgagtaacttttgaaggag

SEQ ID NO: 1397311 - DNA, 22 bp, Artificial Sequence
  chemically synthesized
tggatgagtaacttttgaagga

SEQ ID NO: 1397312 - DNA, 22 bp, Artificial Sequence
  chemically synthesized
cctccttcaaaagttactcatc

SEQ ID NO: 1397313 - DNA, 22 bp, Artificial Sequence
  chemically synthesized
aaaaggattttggatgagtaac

SEQ ID NO: 1397314 - DNA, 22 bp, Artificial Sequence
  chemically synthesized
aaaaaggattttggatgagtaa

SEQ ID NO: 1397315 - DNA, 22 bp, Artificial Sequence
  chemically synthesized
cttcaaaagttactcatccaaa

SEQ ID NO: 1397316 - DNA, 22 bp, Artificial Sequence
  chemically synthesized
caaaagttactcatccaaaatc

SEQ ID NO: 1397317 - DNA, 22 bp, Artificial Sequence
  chemically synthesized
cagtttaaaaaggattttggat

SEQ ID NO: 1397318 - DNA, 22 bp, Artificial Sequence
  chemically synthesized
aaaagttactcatccaaaatcc

SEQ ID NO: 1397319 - DNA, 22 bp, Artificial Sequence
  chemically synthesized
ctcatccaaaatcctttttaaa

SEQ ID NO: 1397320 - DNA, 22 bp, Artificial Sequence
  chemically synthesized
atccaaaatcctttttaaactg

SEQ ID NO: 1397321 - DNA, 22 bp, Artificial Sequence
  chemically synthesized
tacagaatgttacagtttaaaa

SEQ ID NO: 1397322 - DNA, 22 bp, Artificial Sequence
  chemically synthesized
gtgtctgtacagaatgttacag

SEQ ID NO: 1397323 - DNA, 22 bp, Artificial Sequence
  chemically synthesized
tttaaactgtaacattctgtac

SEQ ID NO: 1397324 - DNA, 22 bp, Artificial Sequence
  chemically synthesized
ttaaactgtaacattctgtaca

SEQ ID NO: 1397325 - DNA, 22 bp, Artificial Sequence
  chemically synthesized
taaactgtaacattctgtacag

SEQ ID NO: 1397326 - DNA, 22 bp, Artificial Sequence
  chemically synthesized
aaaaactggtgtctgtacagaa

SEQ ID NO: 1397327 - DNA, 22 bp, Artificial Sequence
  chemically synthesized
aaactgtaacattctgtacaga

SEQ ID NO: 1397328 - DNA, 22 bp, Artificial Sequence
  chemically synthesized
gaaaaactggtgtctgtacaga

SEQ ID NO: 1397329 - DNA, 22 bp, Artificial Sequence
  chemically synthesized
aactgtaacattctgtacagac

SEQ ID NO: 1397330 - DNA, 22 bp, Artificial Sequence
  chemically synthesized
tatttgaaaaactggtgtctgt

SEQ ID NO: 1397331 - DNA, 22 bp, Artificial Sequence
  chemically synthesized
taacattctgtacagacaccag

SEQ ID NO: 1397332 - DNA, 22 bp, Artificial Sequence
  chemically synthesized
gcaattatatttgaaaaactgg

SEQ ID NO: 1397333 - DNA, 22 bp, Artificial Sequence
  chemically synthesized
agcaattatatttgaaaaactg

SEQ ID NO: 1397334 - DNA, 22 bp, Artificial Sequence
  chemically synthesized
tgtacagacaccagtttttcaa

SEQ ID NO: 1397335 - DNA, 22 bp, Artificial Sequence
  chemically synthesized
tacagacaccagtttttcaaat

SEQ ID NO: 1397336 - DNA, 22 bp, Artificial Sequence
  chemically synthesized
acatcttagcaattatatttga

SEQ ID NO: 1397337 - DNA, 22 bp, Artificial Sequence
  chemically synthesized
tgcctcacatcttagcaattat

SEQ ID NO: 1397338 - DNA, 22 bp, Artificial Sequence
  chemically synthesized
atgcctcacatcttagcaatta

SEQ ID NO: 1397339 - DNA, 22 bp, Artificial Sequence
  chemically synthesized
ttcaaatataattgctaagatg

SEQ ID NO: 1397340 - DNA, 22 bp, Artificial Sequence
  chemically synthesized
tcaaatataattgctaagatgt

SEQ ID NO: 1397341 - DNA, 22 bp, Artificial Sequence
  chemically synthesized
tgtttatgcctcacatcttagc

SEQ ID NO: 1397342 - DNA, 22 bp, Artificial Sequence
  chemically synthesized
caaatataattgctaagatgtg

SEQ ID NO: 1397343 - DNA, 22 bp, Artificial Sequence
  chemically synthesized
atgtttatgcctcacatcttag

SEQ ID NO: 1397344 - DNA, 22 bp, Artificial Sequence
  chemically synthesized
aaatataattgctaagatgtga

SEQ ID NO: 1397345 - DNA, 22 bp, Artificial Sequence
  chemically synthesized
gatttatgtttatgcctcacat

SEQ ID NO: 1397346 - DNA, 22 bp, Artificial Sequence
  chemically synthesized
agatttatgtttatgcctcaca

SEQ ID NO: 1397347 - DNA, 22 bp, Artificial Sequence
  chemically synthesized
ctaagatgtgaggcataaacat

SEQ ID NO: 1397348 - DNA, 22 bp, Artificial Sequence
  chemically synthesized
agatgtgaggcataaacataaa

SEQ ID NO: 1397349 - DNA, 22 bp, Artificial Sequence
  chemically synthesized
aatgaaatttagatttatgttt

SEQ ID NO: 1397350 - DNA, 22 bp, Artificial Sequence
  chemically synthesized
cgtggtactcaatgaaatttag

SEQ ID NO: 1397351 - DNA, 22 bp, Artificial Sequence
  chemically synthesized
aacattacgtggtactcaatga

SEQ ID NO: 1397352 - DNA, 22 bp, Artificial Sequence
  chemically synthesized
aatttcattgagtaccacgtaa

SEQ ID NO: 1397353 - DNA, 22 bp, Artificial Sequence
  chemically synthesized
cattgagtaccacgtaatgttc

SEQ ID NO: 1397354 - DNA, 22 bp, Artificial Sequence
  chemically synthesized
attgagtaccacgtaatgttca

SEQ ID NO: 1397355 - DNA, 22 bp, Artificial Sequence
  chemically synthesized
agtaccacgtaatgttcagcta

SEQ ID NO: 1397356 - DNA, 22 bp, Artificial Sequence
  chemically synthesized
caagtatgataatagctgaaca

SEQ ID NO: 1397357 - DNA, 22 bp, Artificial Sequence
  chemically synthesized
ccaagtatgataatagctgaac

SEQ ID NO: 1397358 - DNA, 22 bp, Artificial Sequence
  chemically synthesized
tccatgtgtttccaagtatgat

SEQ ID NO: 1397359 - DNA, 22 bp, Artificial Sequence
  chemically synthesized
atccatgtgtttccaagtatga

SEQ ID NO: 1397360 - DNA, 22 bp, Artificial Sequence
  chemically synthesized
tatccatgtgtttccaagtatg

SEQ ID NO: 1397361 - DNA, 22 bp, Artificial Sequence
  chemically synthesized
agctattatcatacttggaaac

SEQ ID NO: 1397362 - DNA, 22 bp, Artificial Sequence
  chemically synthesized
attttatccatgtgtttccaag

SEQ ID NO: 1397363 - DNA, 22 bp, Artificial Sequence
  chemically synthesized
ttatcatacttggaaacacatg

SEQ ID NO: 1397364 - DNA, 22 bp, Artificial Sequence
  chemically synthesized
tcatacttggaaacacatggat

SEQ ID NO: 1397365 - DNA, 22 bp, Artificial Sequence
  chemically synthesized
aacattcattttatccatgtgt

SEQ ID NO: 1397366 - DNA, 22 bp, Artificial Sequence
  chemically synthesized
caacattcattttatccatgtg

SEQ ID NO: 1397367 - DNA, 22 bp, Artificial Sequence
  chemically synthesized
tttcaacattcattttatccat

SEQ ID NO: 1397368 - DNA, 22 bp, Artificial Sequence
  chemically synthesized
ggaaacacatggataaaatgaa

SEQ ID NO: 1397369 - DNA, 22 bp, Artificial Sequence
  chemically synthesized
gaaacacatggataaaatgaat

SEQ ID NO: 1397370 - DNA, 22 bp, Artificial Sequence
  chemically synthesized
gtagacataccagagtcatgac

SEQ ID NO: 1397371 - DNA, 22 bp, Artificial Sequence
  chemically synthesized
aaatagtcatgactctggtatg

SEQ ID NO: 1397372 - DNA, 22 bp, Artificial Sequence
  chemically synthesized
cgcattggtagacataccagag

SEQ ID NO: 1397373 - DNA, 22 bp, Artificial Sequence
  chemically synthesized
tggtatgtctaccaatgcgcag

SEQ ID NO: 1397374 - DNA, 22 bp, Artificial Sequence
  chemically synthesized
gtatgtctaccaatgcgcagtt

SEQ ID NO: 1397375 - DNA, 22 bp, Artificial Sequence
  chemically synthesized
ccaatgcgcagttgatttatac

SEQ ID NO: 1397376 - DNA, 22 bp, Artificial Sequence
  chemically synthesized
acaataaatgacagtataaatc

SEQ ID NO: 1397377 - DNA, 22 bp, Artificial Sequence
  chemically synthesized
tggcacattcacaataaatgac

SEQ ID NO: 1397378 - DNA, 22 bp, Artificial Sequence
  chemically synthesized
atggcacattcacaataaatga

SEQ ID NO: 1397379 - DNA, 22 bp, Artificial Sequence
  chemically synthesized
atttatactgtcatttattgtg

SEQ ID NO: 1397380 - DNA, 22 bp, Artificial Sequence
  chemically synthesized
atactgtcatttattgtgaatg

SEQ ID NO: 1397381 - DNA, 22 bp, Artificial Sequence
  chemically synthesized
tcatttatggcacattcacaat

SEQ ID NO: 1397382 - DNA, 22 bp, Artificial Sequence
  chemically synthesized
tactgtcatttattgtgaatgt

SEQ ID NO: 1397383 - DNA, 22 bp, Artificial Sequence
  chemically synthesized
gtcatttatggcacattcacaa

SEQ ID NO: 1397384 - DNA, 22 bp, Artificial Sequence
  chemically synthesized
tcatttattgtgaatgtgccat

SEQ ID NO: 1397385 - DNA, 22 bp, Artificial Sequence
  chemically synthesized
attgtgaatgtgccataaatga

SEQ ID NO: 1397386 - DNA, 22 bp, Artificial Sequence
  chemically synthesized
ttgtgaatgtgccataaatgac

SEQ ID NO: 1397387 - DNA, 22 bp, Artificial Sequence
  chemically synthesized
tgaatgtgccataaatgacaag

SEQ ID NO: 1397388 - DNA, 22 bp, Artificial Sequence
  chemically synthesized
aatgtcataagtagcttgtcat

SEQ ID NO: 1397389 - DNA, 22 bp, Artificial Sequence
  chemically synthesized
aattcaatgtcataagtagctt

SEQ ID NO: 1397390 - DNA, 22 bp, Artificial Sequence
  chemically synthesized
caaaaagaatggttcaattcaa

SEQ ID NO: 1397391 - DNA, 22 bp, Artificial Sequence
  chemically synthesized
ccaaaaagaatggttcaattca

SEQ ID NO: 1397392 - DNA, 22 bp, Artificial Sequence
  chemically synthesized
cttatgacattgaattgaacca

SEQ ID NO: 1397393 - DNA, 22 bp, Artificial Sequence
  chemically synthesized
atgacattgaattgaaccattc

SEQ ID NO: 1397394 - DNA, 22 bp, Artificial Sequence
  chemically synthesized
tgacattgaattgaaccattct

SEQ ID NO: 1397395 - DNA, 22 bp, Artificial Sequence
  chemically synthesized
gcatagagacttccaaaaagaa

SEQ ID NO: 1397396 - DNA, 22 bp, Artificial Sequence
  chemically synthesized
aattgaaccattctttttggaa

SEQ ID NO: 1397397 - DNA, 22 bp, Artificial Sequence
  chemically synthesized
aaccattctttttggaagtctc

SEQ ID NO: 1397398 - DNA, 22 bp, Artificial Sequence
  chemically synthesized
gaacaatgtctggcatagagac

SEQ ID NO: 1397399 - DNA, 22 bp, Artificial Sequence
  chemically synthesized
agaacaatgtctggcatagaga

SEQ ID NO: 1397400 - DNA, 22 bp, Artificial Sequence
  chemically synthesized
tagaacaatgtctggcatagag

SEQ ID NO: 1397401 - DNA, 22 bp, Artificial Sequence
  chemically synthesized
tttttggaagtctctatgccag

SEQ ID NO: 1397402 - DNA, 22 bp, Artificial Sequence
  chemically synthesized
tttggaagtctctatgccagac

SEQ ID NO: 1397403 - DNA, 22 bp, Artificial Sequence
  chemically synthesized
ttggaagtctctatgccagaca

SEQ ID NO: 1397404 - DNA, 22 bp, Artificial Sequence
  chemically synthesized
tggaagtctctatgccagacat

SEQ ID NO: 1397405 - DNA, 22 bp, Artificial Sequence
  chemically synthesized
gcctttagaacaatgtctggca

SEQ ID NO: 1397406 - DNA, 22 bp, Artificial Sequence
  chemically synthesized
ggaagtctctatgccagacatt

SEQ ID NO: 1397407 - DNA, 22 bp, Artificial Sequence
  chemically synthesized
agcctttagaacaatgtctggc

SEQ ID NO: 1397408 - DNA, 22 bp, Artificial Sequence
  chemically synthesized
gaagtctctatgccagacattg

SEQ ID NO: 1397409 - DNA, 22 bp, Artificial Sequence
  chemically synthesized
ttagcctttagaacaatgtctg

SEQ ID NO: 1397410 - DNA, 22 bp, Artificial Sequence
  chemically synthesized
aactcttagcctttagaacaat

SEQ ID NO: 1397411 - DNA, 22 bp, Artificial Sequence
  chemically synthesized
aaactcttagcctttagaacaa

SEQ ID NO: 1397412 - DNA, 22 bp, Artificial Sequence
  chemically synthesized
tatgccagacattgttctaaag

SEQ ID NO: 1397413 - DNA, 22 bp, Artificial Sequence
  chemically synthesized
taaactcttagcctttagaaca

SEQ ID NO: 1397414 - DNA, 22 bp, Artificial Sequence
  chemically synthesized
ttaaactcttagcctttagaac

SEQ ID NO: 1397415 - DNA, 22 bp, Artificial Sequence
  chemically synthesized
tgccagacattgttctaaaggc

SEQ ID NO: 1397416 - DNA, 22 bp, Artificial Sequence
  chemically synthesized
aatcttttaaactcttagcctt

SEQ ID NO: 1397417 - DNA, 22 bp, Artificial Sequence
  chemically synthesized
gaatcttttaaactcttagcct

SEQ ID NO: 1397418 - DNA, 22 bp, Artificial Sequence
  chemically synthesized
tgaatcttttaaactcttagcc

SEQ ID NO: 1397419 - DNA, 22 bp, Artificial Sequence
  chemically synthesized
ttgaatcttttaaactcttagc

SEQ ID NO: 1397420 - DNA, 22 bp, Artificial Sequence
  chemically synthesized
ttctaaaggctaagagtttaaa

SEQ ID NO: 1397421 - DNA, 22 bp, Artificial Sequence
  chemically synthesized
tgtttttgaatcttttaaactc

SEQ ID NO: 1397422 - DNA, 22 bp, Artificial Sequence
  chemically synthesized
taaaggctaagagtttaaaaga

SEQ ID NO: 1397423 - DNA, 22 bp, Artificial Sequence
  chemically synthesized
ttgtgtttttgaatcttttaaa

SEQ ID NO: 1397424 - DNA, 22 bp, Artificial Sequence
  chemically synthesized
aaggctaagagtttaaaagatt

SEQ ID NO: 1397425 - DNA, 22 bp, Artificial Sequence
  chemically synthesized
agagtttaaaagattcaaaaac

SEQ ID NO: 1397426 - DNA, 22 bp, Artificial Sequence
  chemically synthesized
gggaactattgtgtttttgaat

SEQ ID NO: 1397427 - DNA, 22 bp, Artificial Sequence
  chemically synthesized
aaaagattcaaaaacacaatag

SEQ ID NO: 1397428 - DNA, 22 bp, Artificial Sequence
  chemically synthesized
aaagattcaaaaacacaatagt

SEQ ID NO: 1397429 - DNA, 22 bp, Artificial Sequence
  chemically synthesized
aaaaacacaatagttccctagt

SEQ ID NO: 1397430 - DNA, 22 bp, Artificial Sequence
  chemically synthesized
cctagtttgccttccttcctac

SEQ ID NO: 1397431 - DNA, 22 bp, Artificial Sequence
  chemically synthesized
gtttgccttccttcctacatgt

SEQ ID NO: 1397432 - DNA, 22 bp, Artificial Sequence
  chemically synthesized
ggagagcaggcaaggacatgta

SEQ ID NO: 1397433 - DNA, 22 bp, Artificial Sequence
  chemically synthesized
gccttccttcctacatgtcctt

SEQ ID NO: 1397434 - DNA, 22 bp, Artificial Sequence
  chemically synthesized
ccttccttcctacatgtccttg

SEQ ID NO: 1397435 - DNA, 22 bp, Artificial Sequence
  chemically synthesized
ccttcctacatgtccttgcctg

SEQ ID NO: 1397436 - DNA, 22 bp, Artificial Sequence
  chemically synthesized
cttcctacatgtccttgcctgc

SEQ ID NO: 1397437 - DNA, 22 bp, Artificial Sequence
  chemically synthesized
cctacatgtccttgcctgctct

SEQ ID NO: 1397438 - DNA, 22 bp, Artificial Sequence
  chemically synthesized
ctacatgtccttgcctgctctc

SEQ ID NO: 1397439 - DNA, 22 bp, Artificial Sequence
  chemically synthesized
gggtaggagttaggagagcagg

SEQ ID NO: 1397440 - DNA, 22 bp, Artificial Sequence
  chemically synthesized
catgtccttgcctgctctccta

SEQ ID NO: 1397441 - DNA, 22 bp, Artificial Sequence
  chemically synthesized
gcctgctctcctaactcctacc

SEQ ID NO: 1397442 - DNA, 22 bp, Artificial Sequence
  chemically synthesized
ggcaaagactggggtaggagtt

SEQ ID NO: 1397443 - DNA, 22 bp, Artificial Sequence
  chemically synthesized
cctgctctcctaactcctaccc

SEQ ID NO: 1397444 - DNA, 22 bp, Artificial Sequence
  chemically synthesized
ctctcctaactcctaccccagt

SEQ ID NO: 1397445 - DNA, 22 bp, Artificial Sequence
  chemically synthesized
tcctaactcctaccccagtctt

SEQ ID NO: 1397446 - DNA, 22 bp, Artificial Sequence
  chemically synthesized
ctaactcctaccccagtctttg

SEQ ID NO: 1397447 - DNA, 22 bp, Artificial Sequence
  chemically synthesized
actcctaccccagtctttgccc

SEQ ID NO: 1397448 - DNA, 22 bp, Artificial Sequence
  chemically synthesized
ctaccccagtctttgcccaact

SEQ ID NO: 1397449 - DNA, 22 bp, Artificial Sequence
  chemically synthesized
ggaaaatgccaaagttgggcaa

SEQ ID NO: 1397450 - DNA, 22 bp, Artificial Sequence
  chemically synthesized
gggaaaatgccaaagttgggca

SEQ ID NO: 1397451 - DNA, 22 bp, Artificial Sequence
  chemically synthesized
ccccagtctttgcccaactttg

SEQ ID NO: 1397452 - DNA, 22 bp, Artificial Sequence
  chemically synthesized
ttgggaaaatgccaaagttggg

SEQ ID NO: 1397453 - DNA, 22 bp, Artificial Sequence
  chemically synthesized
cttgggaaaatgccaaagttgg

SEQ ID NO: 1397454 - DNA, 22 bp, Artificial Sequence
  chemically synthesized
tcttgggaaaatgccaaagttg

SEQ ID NO: 1397455 - DNA, 22 bp, Artificial Sequence
  chemically synthesized
tgcccaactttggcattttccc

SEQ ID NO: 1397456 - DNA, 22 bp, Artificial Sequence
  chemically synthesized
gcccaactttggcattttccca

SEQ ID NO: 1397457 - DNA, 22 bp, Artificial Sequence
  chemically synthesized
cccaactttggcattttcccaa

SEQ ID NO: 1397458 - DNA, 22 bp, Artificial Sequence
  chemically synthesized
gaatgcaatctttcttgggaaa

SEQ ID NO: 1397459 - DNA, 22 bp, Artificial Sequence
  chemically synthesized
ggaatgcaatctttcttgggaa

SEQ ID NO: 1397460 - DNA, 22 bp, Artificial Sequence
  chemically synthesized
ttggaatgcaatctttcttggg

SEQ ID NO: 1397461 - DNA, 22 bp, Artificial Sequence
  chemically synthesized
tggcattttcccaagaaagatt

SEQ ID NO: 1397462 - DNA, 22 bp, Artificial Sequence
  chemically synthesized
ggcattttcccaagaaagattg

SEQ ID NO: 1397463 - DNA, 22 bp, Artificial Sequence
  chemically synthesized
gcattttcccaagaaagattgc

SEQ ID NO: 1397464 - DNA, 22 bp, Artificial Sequence
  chemically synthesized
tgattcttggaatgcaatcttt

SEQ ID NO: 1397465 - DNA, 22 bp, Artificial Sequence
  chemically synthesized
tcccaagaaagattgcattcca

SEQ ID NO: 1397466 - DNA, 22 bp, Artificial Sequence
  chemically synthesized
cccaagaaagattgcattccaa

SEQ ID NO: 1397467 - DNA, 22 bp, Artificial Sequence
  chemically synthesized
ccaagaaagattgcattccaag

SEQ ID NO: 1397468 - DNA, 22 bp, Artificial Sequence
  chemically synthesized
caaataccactgtgattcttgg

SEQ ID NO: 1397469 - DNA, 22 bp, Artificial Sequence
  chemically synthesized
ccaaataccactgtgattcttg

SEQ ID NO: 1397470 - DNA, 22 bp, Artificial Sequence
  chemically synthesized
cattccaagaatcacagtggta

SEQ ID NO: 1397471 - DNA, 22 bp, Artificial Sequence
  chemically synthesized
aaaatatttccaaataccactg

SEQ ID NO: 1397472 - DNA, 22 bp, Artificial Sequence
  chemically synthesized
caagaatcacagtggtatttgg

SEQ ID NO: 1397473 - DNA, 22 bp, Artificial Sequence
  chemically synthesized
gaaatctcaaaatatttccaaa

SEQ ID NO: 1397474 - DNA, 22 bp, Artificial Sequence
  chemically synthesized
cgaaatctcaaaatatttccaa

SEQ ID NO: 1397475 - DNA, 22 bp, Artificial Sequence
  chemically synthesized
tttcgaaatctcaaaatatttc

SEQ ID NO: 1397476 - DNA, 22 bp, Artificial Sequence
  chemically synthesized
atttcgaaatctcaaaatattt

SEQ ID NO: 1397477 - DNA, 22 bp, Artificial Sequence
  chemically synthesized
tttatttcgaaatctcaaaata

SEQ ID NO: 1397478 - DNA, 22 bp, Artificial Sequence
  chemically synthesized
ggaaatattttgagatttcgaa

SEQ ID NO: 1397479 - DNA, 22 bp, Artificial Sequence
  chemically synthesized
gaaatattttgagatttcgaaa

SEQ ID NO: 1397480 - DNA, 22 bp, Artificial Sequence
  chemically synthesized
aaaggaagaattatttatttcg

SEQ ID NO: 1397481 - DNA, 22 bp, Artificial Sequence
  chemically synthesized
aaaaggaagaattatttatttc

SEQ ID NO: 1397482 - DNA, 22 bp, Artificial Sequence
  chemically synthesized
taaaaggaagaattatttattt

SEQ ID NO: 1397483 - DNA, 22 bp, Artificial Sequence
  chemically synthesized
tgagatttcgaaataaataatt

SEQ ID NO: 1397484 - DNA, 22 bp, Artificial Sequence
  chemically synthesized
gagatttcgaaataaataattc

SEQ ID NO: 1397485 - DNA, 22 bp, Artificial Sequence
  chemically synthesized
ttttaaaaggaagaattattta

SEQ ID NO: 1397486 - DNA, 22 bp, Artificial Sequence
  chemically synthesized
agatttcgaaataaataattct

SEQ ID NO: 1397487 - DNA, 22 bp, Artificial Sequence
  chemically synthesized
gttttaaaaggaagaattattt

SEQ ID NO: 1397488 - DNA, 22 bp, Artificial Sequence
  chemically synthesized
tttgttttaaaaggaagaatta

SEQ ID NO: 1397489 - DNA, 22 bp, Artificial Sequence
  chemically synthesized
cgaaataaataattcttccttt

SEQ ID NO: 1397490 - DNA, 22 bp, Artificial Sequence
  chemically synthesized
gaaataaataattcttcctttt

SEQ ID NO: 1397491 - DNA, 22 bp, Artificial Sequence
  chemically synthesized
agaaaaattatttgttttaaaa

SEQ ID NO: 1397492 - DNA, 22 bp, Artificial Sequence
  chemically synthesized
tcagaaaaattatttgttttaa

SEQ ID NO: 1397493 - DNA, 22 bp, Artificial Sequence
  chemically synthesized
attctcagaaaaattatttgtt

SEQ ID NO: 1397494 - DNA, 22 bp, Artificial Sequence
  chemically synthesized
ttccttttaaaacaaataattt

SEQ ID NO: 1397495 - DNA, 22 bp, Artificial Sequence
  chemically synthesized
ccttttaaaacaaataattttt

SEQ ID NO: 1397496 - DNA, 22 bp, Artificial Sequence
  chemically synthesized
attgattctcagaaaaattatt

SEQ ID NO: 1397497 - DNA, 22 bp, Artificial Sequence
  chemically synthesized
cttttaaaacaaataatttttc

SEQ ID NO: 1397498 - DNA, 22 bp, Artificial Sequence
  chemically synthesized
ttaaaacaaataatttttctga

SEQ ID NO: 1397499 - DNA, 22 bp, Artificial Sequence
  chemically synthesized
taaaacaaataatttttctgag

SEQ ID NO: 1397500 - DNA, 22 bp, Artificial Sequence
  chemically synthesized
aaaacaaataatttttctgaga

SEQ ID NO: 1397501 - DNA, 22 bp, Artificial Sequence
  chemically synthesized
aaacaaataatttttctgagaa

SEQ ID NO: 1397502 - DNA, 22 bp, Artificial Sequence
  chemically synthesized
gacgattaattgattctcagaa

SEQ ID NO: 1397503 - DNA, 22 bp, Artificial Sequence
  chemically synthesized
aagttagacgattaattgattc

SEQ ID NO: 1397504 - DNA, 22 bp, Artificial Sequence
  chemically synthesized
aaagttagacgattaattgatt

SEQ ID NO: 1397505 - DNA, 22 bp, Artificial Sequence
  chemically synthesized
tttaaagttagacgattaattg

SEQ ID NO: 1397506 - DNA, 22 bp, Artificial Sequence
  chemically synthesized
atttaaagttagacgattaatt

SEQ ID NO: 1397507 - DNA, 22 bp, Artificial Sequence
  chemically synthesized
ttctgagaatcaattaatcgtc

SEQ ID NO: 1397508 - DNA, 22 bp, Artificial Sequence
  chemically synthesized
tatttaaagttagacgattaat

SEQ ID NO: 1397509 - DNA, 22 bp, Artificial Sequence
  chemically synthesized
tctgagaatcaattaatcgtct

SEQ ID NO: 1397510 - DNA, 22 bp, Artificial Sequence
  chemically synthesized
ctgagaatcaattaatcgtcta

SEQ ID NO: 1397511 - DNA, 22 bp, Artificial Sequence
  chemically synthesized
tgagaatcaattaatcgtctaa

SEQ ID NO: 1397512 - DNA, 22 bp, Artificial Sequence
  chemically synthesized
ctttatttaaagttagacgatt

SEQ ID NO: 1397513 - DNA, 22 bp, Artificial Sequence
  chemically synthesized
actttatttaaagttagacgat

SEQ ID NO: 1397514 - DNA, 22 bp, Artificial Sequence
  chemically synthesized
agaatcaattaatcgtctaact

SEQ ID NO: 1397515 - DNA, 22 bp, Artificial Sequence
  chemically synthesized
tactttatttaaagttagacga

SEQ ID NO: 1397516 - DNA, 22 bp, Artificial Sequence
  chemically synthesized
ttactttatttaaagttagacg

SEQ ID NO: 1397517 - DNA, 22 bp, Artificial Sequence
  chemically synthesized
tccatttttactttatttaaag

SEQ ID NO: 1397518 - DNA, 22 bp, Artificial Sequence
  chemically synthesized
atcgtctaactttaaataaagt

SEQ ID NO: 1397519 - DNA, 22 bp, Artificial Sequence
  chemically synthesized
ctatccatttttactttattta

SEQ ID NO: 1397520 - DNA, 22 bp, Artificial Sequence
  chemically synthesized
attcctatccatttttacttta

SEQ ID NO: 1397521 - DNA, 22 bp, Artificial Sequence
  chemically synthesized
aattcctatccatttttacttt

SEQ ID NO: 1397522 - DNA, 22 bp, Artificial Sequence
  chemically synthesized
actttaaataaagtaaaaatgg

SEQ ID NO: 1397523 - DNA, 22 bp, Artificial Sequence
  chemically synthesized
gagtttaattcctatccatttt

SEQ ID NO: 1397524 - DNA, 22 bp, Artificial Sequence
  chemically synthesized
taaataaagtaaaaatggatag

SEQ ID NO: 1397525 - DNA, 22 bp, Artificial Sequence
  chemically synthesized
aaataaagtaaaaatggatagg

SEQ ID NO: 1397526 - DNA, 22 bp, Artificial Sequence
  chemically synthesized
aataaagtaaaaatggatagga

SEQ ID NO: 1397527 - DNA, 22 bp, Artificial Sequence
  chemically synthesized
aatatattggagtttaattcct

SEQ ID NO: 1397528 - DNA, 22 bp, Artificial Sequence
  chemically synthesized
cctcaatatattggagtttaat

SEQ ID NO: 1397529 - DNA, 22 bp, Artificial Sequence
  chemically synthesized
gcctcaatatattggagtttaa

SEQ ID NO: 1397530 - DNA, 22 bp, Artificial Sequence
  chemically synthesized
tttgcctcaatatattggagtt

SEQ ID NO: 1397531 - DNA, 22 bp, Artificial Sequence
  chemically synthesized
aactccaatatattgaggcaaa

SEQ ID NO: 1397532 - DNA, 22 bp, Artificial Sequence
  chemically synthesized
aaaataaagactgtttgcctca

SEQ ID NO: 1397533 - DNA, 22 bp, Artificial Sequence
  chemically synthesized
caaaataaagactgtttgcctc

SEQ ID NO: 1397534 - DNA, 22 bp, Artificial Sequence
  chemically synthesized
tcaaaataaagactgtttgcct

SEQ ID NO: 1397535 - DNA, 22 bp, Artificial Sequence
  chemically synthesized
caatatattgaggcaaacagtc

SEQ ID NO: 1397536 - DNA, 22 bp, Artificial Sequence
  chemically synthesized
aaaaggattttcaaaataaaga

SEQ ID NO: 1397537 - DNA, 22 bp, Artificial Sequence
  chemically synthesized
aaaaaggattttcaaaataaag

SEQ ID NO: 1397538 - DNA, 22 bp, Artificial Sequence
  chemically synthesized
aggcaaacagtctttattttga

SEQ ID NO: 1397539 - DNA, 22 bp, Artificial Sequence
  chemically synthesized
taaaaaggattttcaaaataaa

SEQ ID NO: 1397540 - DNA, 22 bp, Artificial Sequence
  chemically synthesized
tggaaacctttaaaaaggattt

SEQ ID NO: 1397541 - DNA, 22 bp, Artificial Sequence
  chemically synthesized
gtggaaacctttaaaaaggatt

SEQ ID NO: 1397542 - DNA, 22 bp, Artificial Sequence
  chemically synthesized
tattttgaaaatcctttttaaa

SEQ ID NO: 1397543 - DNA, 22 bp, Artificial Sequence
  chemically synthesized
tttgtggaaacctttaaaaagg

SEQ ID NO: 1397544 - DNA, 22 bp, Artificial Sequence
  chemically synthesized
attttgaaaatcctttttaaag

SEQ ID NO: 1397545 - DNA, 22 bp, Artificial Sequence
  chemically synthesized
ttttgaaaatcctttttaaagg

SEQ ID NO: 1397546 - DNA, 22 bp, Artificial Sequence
  chemically synthesized
tgaaaatcctttttaaaggttt

SEQ ID NO: 1397547 - DNA, 22 bp, Artificial Sequence
  chemically synthesized
gaaaatcctttttaaaggtttc

SEQ ID NO: 1397548 - DNA, 22 bp, Artificial Sequence
  chemically synthesized
aaaatcctttttaaaggtttcc

SEQ ID NO: 1397549 - DNA, 22 bp, Artificial Sequence
  chemically synthesized
aagagttatttgtggaaacctt

SEQ ID NO: 1397550 - DNA, 22 bp, Artificial Sequence
  chemically synthesized
aaagagttatttgtggaaacct

SEQ ID NO: 1397551 - DNA, 22 bp, Artificial Sequence
  chemically synthesized
taaagagttatttgtggaaacc

SEQ ID NO: 1397552 - DNA, 22 bp, Artificial Sequence
  chemically synthesized
ctttaaagagttatttgtggaa

SEQ ID NO: 1397553 - DNA, 22 bp, Artificial Sequence
  chemically synthesized
cctttaaagagttatttgtgga

SEQ ID NO: 1397554 - DNA, 22 bp, Artificial Sequence
  chemically synthesized
tcctttaaagagttatttgtgg

SEQ ID NO: 1397555 - DNA, 22 bp, Artificial Sequence
  chemically synthesized
tttaaaggtttccacaaataac

SEQ ID NO: 1397556 - DNA, 22 bp, Artificial Sequence
  chemically synthesized
ttaaaggtttccacaaataact

SEQ ID NO: 1397557 - DNA, 22 bp, Artificial Sequence
  chemically synthesized
taaaggtttccacaaataactc

SEQ ID NO: 1397558 - DNA, 22 bp, Artificial Sequence
  chemically synthesized
aaaggtttccacaaataactct

SEQ ID NO: 1397559 - DNA, 22 bp, Artificial Sequence
  chemically synthesized
aaggtttccacaaataactctt

SEQ ID NO: 1397560 - DNA, 22 bp, Artificial Sequence
  chemically synthesized
gccctttcctttaaagagttat

SEQ ID NO: 1397561 - DNA, 22 bp, Artificial Sequence
  chemically synthesized
ccacaaataactctttaaagga

SEQ ID NO: 1397562 - DNA, 22 bp, Artificial Sequence
  chemically synthesized
cacaaataactctttaaaggaa

SEQ ID NO: 1397563 - DNA, 22 bp, Artificial Sequence
  chemically synthesized
aaggaaatattagccctttcct

SEQ ID NO: 1397564 - DNA, 22 bp, Artificial Sequence
  chemically synthesized
ctgaaggaaatattagcccttt

SEQ ID NO: 1397565 - DNA, 22 bp, Artificial Sequence
  chemically synthesized
cctgaaggaaatattagccctt

SEQ ID NO: 1397566 - DNA, 22 bp, Artificial Sequence
  chemically synthesized
tcctgaaggaaatattagccct

SEQ ID NO: 1397567 - DNA, 22 bp, Artificial Sequence
  chemically synthesized
tttaaaggaaagggctaatatt

SEQ ID NO: 1397568 - DNA, 22 bp, Artificial Sequence
  chemically synthesized
taaaggaaagggctaatatttc

SEQ ID NO: 1397569 - DNA, 22 bp, Artificial Sequence
  chemically synthesized
aaaggaaagggctaatatttcc

SEQ ID NO: 1397570 - DNA, 22 bp, Artificial Sequence
  chemically synthesized
aaggaaagggctaatatttcct

SEQ ID NO: 1397571 - DNA, 22 bp, Artificial Sequence
  chemically synthesized
taaattttcctgaaggaaatat

SEQ ID NO: 1397572 - DNA, 22 bp, Artificial Sequence
  chemically synthesized
ttgtaaattttcctgaaggaaa

SEQ ID NO: 1397573 - DNA, 22 bp, Artificial Sequence
  chemically synthesized
acagattgttgtaaattttcct

SEQ ID NO: 1397574 - DNA, 22 bp, Artificial Sequence
  chemically synthesized
atatttccttcaggaaaattta

SEQ ID NO: 1397575 - DNA, 22 bp, Artificial Sequence
  chemically synthesized
gttaacagattgttgtaaattt

SEQ ID NO: 1397576 - DNA, 22 bp, Artificial Sequence
  chemically synthesized
ggttaacagattgttgtaaatt

SEQ ID NO: 1397577 - DNA, 22 bp, Artificial Sequence
  chemically synthesized
ccttcaggaaaatttacaacaa

SEQ ID NO: 1397578 - DNA, 22 bp, Artificial Sequence
  chemically synthesized
cttcaggaaaatttacaacaat

SEQ ID NO: 1397579 - DNA, 22 bp, Artificial Sequence
  chemically synthesized
gtttggttaacagattgttgta

SEQ ID NO: 1397580 - DNA, 22 bp, Artificial Sequence
  chemically synthesized
caggaaaatttacaacaatctg

SEQ ID NO: 1397581 - DNA, 22 bp, Artificial Sequence
  chemically synthesized
aggaaaatttacaacaatctgt

SEQ ID NO: 1397582 - DNA, 22 bp, Artificial Sequence
  chemically synthesized
aagatctagtttggttaacaga

SEQ ID NO: 1397583 - DNA, 22 bp, Artificial Sequence
  chemically synthesized
gaagatctagtttggttaacag

SEQ ID NO: 1397584 - DNA, 22 bp, Artificial Sequence
  chemically synthesized
acaacaatctgttaaccaaact

SEQ ID NO: 1397585 - DNA, 22 bp, Artificial Sequence
  chemically synthesized
caacaatctgttaaccaaacta

SEQ ID NO: 1397586 - DNA, 22 bp, Artificial Sequence
  chemically synthesized
gtaaggggcttgaagatctagt

SEQ ID NO: 1397587 - DNA, 22 bp, Artificial Sequence
  chemically synthesized
ttaaccaaactagatcttcaag

SEQ ID NO: 1397588 - DNA, 22 bp, Artificial Sequence
  chemically synthesized
accaaactagatcttcaagccc

SEQ ID NO: 1397589 - DNA, 22 bp, Artificial Sequence
  chemically synthesized
gggagaggaattggtaaggggc

SEQ ID NO: 1397590 - DNA, 22 bp, Artificial Sequence
  chemically synthesized
gatcttcaagccccttaccaat

SEQ ID NO: 1397591 - DNA, 22 bp, Artificial Sequence
  chemically synthesized
aattggggagaggaattggtaa

SEQ ID NO: 1397592 - DNA, 22 bp, Artificial Sequence
  chemically synthesized
caagccccttaccaattcctct

SEQ ID NO: 1397593 - DNA, 22 bp, Artificial Sequence
  chemically synthesized
aagccccttaccaattcctctc

SEQ ID NO: 1397594 - DNA, 22 bp, Artificial Sequence
  chemically synthesized
gaaaacactcaattggggagag

SEQ ID NO: 1397595 - DNA, 22 bp, Artificial Sequence
  chemically synthesized
ggaaaacactcaattggggaga

SEQ ID NO: 1397596 - DNA, 22 bp, Artificial Sequence
  chemically synthesized
tggaaaacactcaattggggag

SEQ ID NO: 1397597 - DNA, 22 bp, Artificial Sequence
  chemically synthesized
accaattcctctccccaattga

SEQ ID NO: 1397598 - DNA, 22 bp, Artificial Sequence
  chemically synthesized
ccaattcctctccccaattgag

SEQ ID NO: 1397599 - DNA, 22 bp, Artificial Sequence
  chemically synthesized
gacctttggaaaacactcaatt

SEQ ID NO: 1397600 - DNA, 22 bp, Artificial Sequence
  chemically synthesized
ctctccccaattgagtgttttc

SEQ ID NO: 1397601 - DNA, 22 bp, Artificial Sequence
  chemically synthesized
tccccaattgagtgttttccaa

SEQ ID NO: 1397602 - DNA, 22 bp, Artificial Sequence
  chemically synthesized
caaattggacctttggaaaaca

SEQ ID NO: 1397603 - DNA, 22 bp, Artificial Sequence
  chemically synthesized
cccaattgagtgttttccaaag

SEQ ID NO: 1397604 - DNA, 22 bp, Artificial Sequence
  chemically synthesized
agtgttttccaaaggtccaatt

SEQ ID NO: 1397605 - DNA, 22 bp, Artificial Sequence
  chemically synthesized
tccaaaggtccaatttggaatt

SEQ ID NO: 1397606 - DNA, 22 bp, Artificial Sequence
  chemically synthesized
ccaaaggtccaatttggaattc

SEQ ID NO: 1397607 - DNA, 22 bp, Artificial Sequence
  chemically synthesized
caaaggtccaatttggaattcc

SEQ ID NO: 1397608 - DNA, 22 bp, Artificial Sequence
  chemically synthesized
ggaattccttttctttttcttt

SEQ ID NO: 1397609 - DNA, 22 bp, Artificial Sequence
  chemically synthesized
cagaaaggaaaaaaagaaaaag

SEQ ID NO: 1397610 - DNA, 22 bp, Artificial Sequence
  chemically synthesized
gaattccttttctttttctttt

SEQ ID NO: 1397611 - DNA, 22 bp, Artificial Sequence
  chemically synthesized
acagaaaggaaaaaaagaaaaa

SEQ ID NO: 1397612 - DNA, 22 bp, Artificial Sequence
  chemically synthesized
tacagaaaggaaaaaaagaaaa

SEQ ID NO: 1397613 - DNA, 22 bp, Artificial Sequence
  chemically synthesized
cttttctttttctttttttcct

SEQ ID NO: 1397614 - DNA, 22 bp, Artificial Sequence
  chemically synthesized
accctttacagaaaggaaaaaa

SEQ ID NO: 1397615 - DNA, 22 bp, Artificial Sequence
  chemically synthesized
ttctttttctttttttcctttc

SEQ ID NO: 1397616 - DNA, 22 bp, Artificial Sequence
  chemically synthesized
tctttttctttttttcctttct

SEQ ID NO: 1397617 - DNA, 22 bp, Artificial Sequence
  chemically synthesized
ctttttctttttttcctttctg

SEQ ID NO: 1397618 - DNA, 22 bp, Artificial Sequence
  chemically synthesized
tttttctttttttcctttctgt

SEQ ID NO: 1397619 - DNA, 22 bp, Artificial Sequence
  chemically synthesized
tttctttttttcctttctgtaa

SEQ ID NO: 1397620 - DNA, 22 bp, Artificial Sequence
  chemically synthesized
ttctttttttcctttctgtaaa

SEQ ID NO: 1397621 - DNA, 22 bp, Artificial Sequence
  chemically synthesized
tctttttttcctttctgtaaag

SEQ ID NO: 1397622 - DNA, 22 bp, Artificial Sequence
  chemically synthesized
agtatgctcaccctttacagaa

SEQ ID NO: 1397623 - DNA, 22 bp, Artificial Sequence
  chemically synthesized
ctttttttcctttctgtaaagg

SEQ ID NO: 1397624 - DNA, 22 bp, Artificial Sequence
  chemically synthesized
tttttttcctttctgtaaaggg

SEQ ID NO: 1397625 - DNA, 22 bp, Artificial Sequence
  chemically synthesized
ctaagtatgctcaccctttaca

SEQ ID NO: 1397626 - DNA, 22 bp, Artificial Sequence
  chemically synthesized
tttttcctttctgtaaagggtg

SEQ ID NO: 1397627 - DNA, 22 bp, Artificial Sequence
  chemically synthesized
cctaagtatgctcaccctttac

SEQ ID NO: 1397628 - DNA, 22 bp, Artificial Sequence
  chemically synthesized
ttttcctttctgtaaagggtga

SEQ ID NO: 1397629 - DNA, 22 bp, Artificial Sequence
  chemically synthesized
tttcctttctgtaaagggtgag

SEQ ID NO: 1397630 - DNA, 22 bp, Artificial Sequence
  chemically synthesized
ttcctttctgtaaagggtgagc

SEQ ID NO: 1397631 - DNA, 22 bp, Artificial Sequence
  chemically synthesized
tcctttctgtaaagggtgagca

SEQ ID NO: 1397632 - DNA, 22 bp, Artificial Sequence
  chemically synthesized
atttcctaagtatgctcaccct

SEQ ID NO: 1397633 - DNA, 22 bp, Artificial Sequence
  chemically synthesized
cctttctgtaaagggtgagcat

SEQ ID NO: 1397634 - DNA, 22 bp, Artificial Sequence
  chemically synthesized
ctttctgtaaagggtgagcata

SEQ ID NO: 1397635 - DNA, 22 bp, Artificial Sequence
  chemically synthesized
actaatttcctaagtatgctca

SEQ ID NO: 1397636 - DNA, 22 bp, Artificial Sequence
  chemically synthesized
tctgtaaagggtgagcatactt

SEQ ID NO: 1397637 - DNA, 22 bp, Artificial Sequence
  chemically synthesized
aactaatttcctaagtatgctc

SEQ ID NO: 1397638 - DNA, 22 bp, Artificial Sequence
  chemically synthesized
ctgtaaagggtgagcatactta

SEQ ID NO: 1397639 - DNA, 22 bp, Artificial Sequence
  chemically synthesized
taactaatttcctaagtatgct

SEQ ID NO: 1397640 - DNA, 22 bp, Artificial Sequence
  chemically synthesized
tgtaaagggtgagcatacttag

SEQ ID NO: 1397641 - DNA, 22 bp, Artificial Sequence
  chemically synthesized
taaagggtgagcatacttagga

SEQ ID NO: 1397642 - DNA, 22 bp, Artificial Sequence
  chemically synthesized
aatggagtaattttaactaatt

SEQ ID NO: 1397643 - DNA, 22 bp, Artificial Sequence
  chemically synthesized
aggaaattagttaaaattactc

SEQ ID NO: 1397644 - DNA, 22 bp, Artificial Sequence
  chemically synthesized
ggaaattagttaaaattactcc

SEQ ID NO: 1397645 - DNA, 22 bp, Artificial Sequence
  chemically synthesized
gttaaaattactccattgaatg

SEQ ID NO: 1397646 - DNA, 22 bp, Artificial Sequence
  chemically synthesized
aggaacaacagagcattcaatg

SEQ ID NO: 1397647 - DNA, 22 bp, Artificial Sequence
  chemically synthesized
aaattactccattgaatgctct

SEQ ID NO: 1397648 - DNA, 22 bp, Artificial Sequence
  chemically synthesized
aatactaaggaacaacagagca

SEQ ID NO: 1397649 - DNA, 22 bp, Artificial Sequence
  chemically synthesized
ctccattgaatgctctgttgtt

SEQ ID NO: 1397650 - DNA, 22 bp, Artificial Sequence
  chemically synthesized
cctcaatactaaggaacaacag

SEQ ID NO: 1397651 - DNA, 22 bp, Artificial Sequence
  chemically synthesized
cattgaatgctctgttgttcct

SEQ ID NO: 1397652 - DNA, 22 bp, Artificial Sequence
  chemically synthesized
ccctcaatactaaggaacaaca

SEQ ID NO: 1397653 - DNA, 22 bp, Artificial Sequence
  chemically synthesized
aatgctctgttgttccttagta

SEQ ID NO: 1397654 - DNA, 22 bp, Artificial Sequence
  chemically synthesized
aaccttccctcaatactaagga

SEQ ID NO: 1397655 - DNA, 22 bp, Artificial Sequence
  chemically synthesized
tgttgttccttagtattgaggg

SEQ ID NO: 1397656 - DNA, 22 bp, Artificial Sequence
  chemically synthesized
ttgttccttagtattgagggaa

SEQ ID NO: 1397657 - DNA, 22 bp, Artificial Sequence
  chemically synthesized
acatatgttgaaccttccctca

SEQ ID NO: 1397658 - DNA, 22 bp, Artificial Sequence
  chemically synthesized
ttccttagtattgagggaaggt

SEQ ID NO: 1397659 - DNA, 22 bp, Artificial Sequence
  chemically synthesized
cttagtattgagggaaggttca

SEQ ID NO: 1397660 - DNA, 22 bp, Artificial Sequence
  chemically synthesized
agtattgagggaaggttcaaca

SEQ ID NO: 1397661 - DNA, 22 bp, Artificial Sequence
  chemically synthesized
gtattgagggaaggttcaacat

SEQ ID NO: 1397662 - DNA, 22 bp, Artificial Sequence
  chemically synthesized
ccaaaattaacatatgttgaac

SEQ ID NO: 1397663 - DNA, 22 bp, Artificial Sequence
  chemically synthesized
agggaaggttcaacatatgtta

SEQ ID NO: 1397664 - DNA, 22 bp, Artificial Sequence
  chemically synthesized
aaaaaattcccaaaattaacat

SEQ ID NO: 1397665 - DNA, 22 bp, Artificial Sequence
  chemically synthesized
aacatatgttaattttgggaat

SEQ ID NO: 1397666 - DNA, 22 bp, Artificial Sequence
  chemically synthesized
cagtatctaaaaaaattcccaa

SEQ ID NO: 1397667 - DNA, 22 bp, Artificial Sequence
  chemically synthesized
gcagtatctaaaaaaattccca

SEQ ID NO: 1397668 - DNA, 22 bp, Artificial Sequence
  chemically synthesized
attttgggaatttttttagata

SEQ ID NO: 1397669 - DNA, 22 bp, Artificial Sequence
  chemically synthesized
tgggaatttttttagatactgc

SEQ ID NO: 1397670 - DNA, 22 bp, Artificial Sequence
  chemically synthesized
gggaatttttttagatactgca

SEQ ID NO: 1397671 - DNA, 22 bp, Artificial Sequence
  chemically synthesized
ggaatttttttagatactgcaa

SEQ ID NO: 1397672 - DNA, 22 bp, Artificial Sequence
  chemically synthesized
catgtgatagtcttgcagtatc

SEQ ID NO: 1397673 - DNA, 22 bp, Artificial Sequence
  chemically synthesized
agctacatgtgatagtcttgca

SEQ ID NO: 1397674 - DNA, 22 bp, Artificial Sequence
  chemically synthesized
ttttagatactgcaagactatc

SEQ ID NO: 1397675 - DNA, 22 bp, Artificial Sequence
  chemically synthesized
tttagatactgcaagactatca

SEQ ID NO: 1397676 - DNA, 22 bp, Artificial Sequence
  chemically synthesized
ttagatactgcaagactatcac

SEQ ID NO: 1397677 - DNA, 22 bp, Artificial Sequence
  chemically synthesized
tagatactgcaagactatcaca

SEQ ID NO: 1397678 - DNA, 22 bp, Artificial Sequence
  chemically synthesized
agatactgcaagactatcacat

SEQ ID NO: 1397679 - DNA, 22 bp, Artificial Sequence
  chemically synthesized
gatactgcaagactatcacatg

SEQ ID NO: 1397680 - DNA, 22 bp, Artificial Sequence
  chemically synthesized
tgagactaagctacatgtgata

SEQ ID NO: 1397681 - DNA, 22 bp, Artificial Sequence
  chemically synthesized
ctgtgagactaagctacatgtg

SEQ ID NO: 1397682 - DNA, 22 bp, Artificial Sequence
  chemically synthesized
gctgtgagactaagctacatgt

SEQ ID NO: 1397683 - DNA, 22 bp, Artificial Sequence
  chemically synthesized
caagactatcacatgtagctta

SEQ ID NO: 1397684 - DNA, 22 bp, Artificial Sequence
  chemically synthesized
tcacatgtagcttagtctcaca

SEQ ID NO: 1397685 - DNA, 22 bp, Artificial Sequence
  chemically synthesized
tgtggatatccttgctgtgaga

SEQ ID NO: 1397686 - DNA, 22 bp, Artificial Sequence
  chemically synthesized
agtctcacagcaaggatatcca

SEQ ID NO: 1397687 - DNA, 22 bp, Artificial Sequence
  chemically synthesized
gtctcacagcaaggatatccac

SEQ ID NO: 1397688 - DNA, 22 bp, Artificial Sequence
  chemically synthesized
atagcacgttgtgtggatatcc

SEQ ID NO: 1397689 - DNA, 22 bp, Artificial Sequence
  chemically synthesized
ctaatagcacgttgtgtggata

SEQ ID NO: 1397690 - DNA, 22 bp, Artificial Sequence
  chemically synthesized
gctaatagcacgttgtgtggat

SEQ ID NO: 1397691 - DNA, 22 bp, Artificial Sequence
  chemically synthesized
acagcaaggatatccacacaac

SEQ ID NO: 1397692 - DNA, 22 bp, Artificial Sequence
  chemically synthesized
cttgctaatagcacgttgtgtg

SEQ ID NO: 1397693 - DNA, 22 bp, Artificial Sequence
  chemically synthesized
gcatcctacttgctaatagcac

SEQ ID NO: 1397694 - DNA, 22 bp, Artificial Sequence
  chemically synthesized
tggcggctggcatcctacttgc

SEQ ID NO: 1397695 - DNA, 22 bp, Artificial Sequence
  chemically synthesized
gtctgtggcggctggcatccta

SEQ ID NO: 1397696 - DNA, 22 bp, Artificial Sequence
  chemically synthesized
ttagcaagtaggatgccagccg

SEQ ID NO: 1397697 - DNA, 22 bp, Artificial Sequence
  chemically synthesized
atactggtctgtggcggctggc

SEQ ID NO: 1397698 - DNA, 22 bp, Artificial Sequence
  chemically synthesized
gcaagtaggatgccagccgcca

SEQ ID NO: 1397699 - DNA, 22 bp, Artificial Sequence
  chemically synthesized
ggctaatactggtctgtggcgg

SEQ ID NO: 1397700 - DNA, 22 bp, Artificial Sequence
  chemically synthesized
ttaggctaatactggtctgtgg

SEQ ID NO: 1397701 - DNA, 22 bp, Artificial Sequence
  chemically synthesized
atcctattaggctaatactggt

SEQ ID NO: 1397702 - DNA, 22 bp, Artificial Sequence
  chemically synthesized
catcctattaggctaatactgg

SEQ ID NO: 1397703 - DNA, 22 bp, Artificial Sequence
  chemically synthesized
tcatcctattaggctaatactg

SEQ ID NO: 1397704 - DNA, 22 bp, Artificial Sequence
  chemically synthesized
tatcaaaatatctttcatccta

SEQ ID NO: 1397705 - DNA, 22 bp, Artificial Sequence
  chemically synthesized
atatcaaaatatctttcatcct

SEQ ID NO: 1397706 - DNA, 22 bp, Artificial Sequence
  chemically synthesized
tttatatcaaaatatctttcat

SEQ ID NO: 1397707 - DNA, 22 bp, Artificial Sequence
  chemically synthesized
gtttatatcaaaatatctttca

SEQ ID NO: 1397708 - DNA, 22 bp, Artificial Sequence
  chemically synthesized
gcctaataggatgaaagatatt

SEQ ID NO: 1397709 - DNA, 22 bp, Artificial Sequence
  chemically synthesized
ataggatgaaagatattttgat

SEQ ID NO: 1397710 - DNA, 22 bp, Artificial Sequence
  chemically synthesized
gcatgtttgtttatatcaaaat

SEQ ID NO: 1397711 - DNA, 22 bp, Artificial Sequence
  chemically synthesized
tgtggtctcgcatgtttgttta

SEQ ID NO: 1397712 - DNA, 22 bp, Artificial Sequence
  chemically synthesized
actgtgtggtctcgcatgtttg

SEQ ID NO: 1397713 - DNA, 22 bp, Artificial Sequence
  chemically synthesized
tgatataaacaaacatgcgaga

SEQ ID NO: 1397714 - DNA, 22 bp, Artificial Sequence
  chemically synthesized
ctgactgtgtggtctcgcatgt

SEQ ID NO: 1397715 - DNA, 22 bp, Artificial Sequence
  chemically synthesized
gatataaacaaacatgcgagac

SEQ ID NO: 1397716 - DNA, 22 bp, Artificial Sequence
  chemically synthesized
actgactgtgtggtctcgcatg

SEQ ID NO: 1397717 - DNA, 22 bp, Artificial Sequence
  chemically synthesized
atataaacaaacatgcgagacc

SEQ ID NO: 1397718 - DNA, 22 bp, Artificial Sequence
  chemically synthesized
taaaatgtttactgactgtgtg

SEQ ID NO: 1397719 - DNA, 22 bp, Artificial Sequence
  chemically synthesized
tctataaaatgtttactgactg

SEQ ID NO: 1397720 - DNA, 22 bp, Artificial Sequence
  chemically synthesized
gtctataaaatgtttactgact

SEQ ID NO: 1397721 - DNA, 22 bp, Artificial Sequence
  chemically synthesized
tgtctataaaatgtttactgac

SEQ ID NO: 1397722 - DNA, 22 bp, Artificial Sequence
  chemically synthesized
ttgtctataaaatgtttactga

SEQ ID NO: 1397723 - DNA, 22 bp, Artificial Sequence
  chemically synthesized
cttttgtctataaaatgtttac

SEQ ID NO: 1397724 - DNA, 22 bp, Artificial Sequence
  chemically synthesized
tccttttgtctataaaatgttt

SEQ ID NO: 1397725 - DNA, 22 bp, Artificial Sequence
  chemically synthesized
gagttctccttttgtctataaa

SEQ ID NO: 1397726 - DNA, 22 bp, Artificial Sequence
  chemically synthesized
tatagacaaaaggagaactcta

SEQ ID NO: 1397727 - DNA, 22 bp, Artificial Sequence
  chemically synthesized
atagacaaaaggagaactctaa

SEQ ID NO: 1397728 - DNA, 22 bp, Artificial Sequence
  chemically synthesized
tagacaaaaggagaactctaat

SEQ ID NO: 1397729 - DNA, 22 bp, Artificial Sequence
  chemically synthesized
caaaggccaaatgaatgtcatt

SEQ ID NO: 1397730 - DNA, 22 bp, Artificial Sequence
  chemically synthesized
tccaaaggccaaatgaatgtca

SEQ ID NO: 1397731 - DNA, 22 bp, Artificial Sequence
  chemically synthesized
taatgacattcatttggccttt

SEQ ID NO: 1397732 - DNA, 22 bp, Artificial Sequence
  chemically synthesized
atgacattcatttggcctttgg

SEQ ID NO: 1397733 - DNA, 22 bp, Artificial Sequence
  chemically synthesized
atttggcctttggagaggatgc

SEQ ID NO: 1397734 - DNA, 22 bp, Artificial Sequence
  chemically synthesized
ggcctttggagaggatgcattc

SEQ ID NO: 1397735 - DNA, 22 bp, Artificial Sequence
  chemically synthesized
gcctttggagaggatgcattcg

SEQ ID NO: 1397736 - DNA, 22 bp, Artificial Sequence
  chemically synthesized
tggagaggatgcattcggggca

SEQ ID NO: 1397737 - DNA, 22 bp, Artificial Sequence
  chemically synthesized
taacatgaaaaatgccccgaat

SEQ ID NO: 1397738 - DNA, 22 bp, Artificial Sequence
  chemically synthesized
ggagaggatgcattcggggcat

SEQ ID NO: 1397739 - DNA, 22 bp, Artificial Sequence
  chemically synthesized
ataacatgaaaaatgccccgaa

SEQ ID NO: 1397740 - DNA, 22 bp, Artificial Sequence
  chemically synthesized
gagaggatgcattcggggcatt

SEQ ID NO: 1397741 - DNA, 22 bp, Artificial Sequence
  chemically synthesized
tataacatgaaaaatgccccga

SEQ ID NO: 1397742 - DNA, 22 bp, Artificial Sequence
  chemically synthesized
tcctttataacatgaaaaatgc

SEQ ID NO: 1397743 - DNA, 22 bp, Artificial Sequence
  chemically synthesized
aattatcctttataacatgaaa

SEQ ID NO: 1397744 - DNA, 22 bp, Artificial Sequence
  chemically synthesized
ggggcatttttcatgttataaa

SEQ ID NO: 1397745 - DNA, 22 bp, Artificial Sequence
  chemically synthesized
gattcaattatcctttataaca

SEQ ID NO: 1397746 - DNA, 22 bp, Artificial Sequence
  chemically synthesized
ggattcaattatcctttataac

SEQ ID NO: 1397747 - DNA, 22 bp, Artificial Sequence
  chemically synthesized
tttggattcaattatcctttat

SEQ ID NO: 1397748 - DNA, 22 bp, Artificial Sequence
  chemically synthesized
ttcatgttataaaggataattg

SEQ ID NO: 1397749 - DNA, 22 bp, Artificial Sequence
  chemically synthesized
tcatgttataaaggataattga

SEQ ID NO: 1397750 - DNA, 22 bp, Artificial Sequence
  chemically synthesized
catgttataaaggataattgaa

SEQ ID NO: 1397751 - DNA, 22 bp, Artificial Sequence
  chemically synthesized
atgttataaaggataattgaat

SEQ ID NO: 1397752 - DNA, 22 bp, Artificial Sequence
  chemically synthesized
taaaggataattgaatccaaac

SEQ ID NO: 1397753 - DNA, 22 bp, Artificial Sequence
  chemically synthesized
ccatatgaacactgtttggatt

SEQ ID NO: 1397754 - DNA, 22 bp, Artificial Sequence
  chemically synthesized
gtgttcccatatgaacactgtt

SEQ ID NO: 1397755 - DNA, 22 bp, Artificial Sequence
  chemically synthesized
agtgttcccatatgaacactgt

SEQ ID NO: 1397756 - DNA, 22 bp, Artificial Sequence
  chemically synthesized
tagtgttcccatatgaacactg

SEQ ID NO: 1397757 - DNA, 22 bp, Artificial Sequence
  chemically synthesized
aatccaaacagtgttcatatgg

SEQ ID NO: 1397758 - DNA, 22 bp, Artificial Sequence
  chemically synthesized
gagctttagtgttcccatatga

SEQ ID NO: 1397759 - DNA, 22 bp, Artificial Sequence
  chemically synthesized
ttagagctttagtgttcccata

SEQ ID NO: 1397760 - DNA, 22 bp, Artificial Sequence
  chemically synthesized
tgtactgttagagctttagtgt

SEQ ID NO: 1397761 - DNA, 22 bp, Artificial Sequence
  chemically synthesized
ttatgtactgttagagctttag

SEQ ID NO: 1397762 - DNA, 22 bp, Artificial Sequence
  chemically synthesized
atatgggaacactaaagctcta

SEQ ID NO: 1397763 - DNA, 22 bp, Artificial Sequence
  chemically synthesized
tgttatgtactgttagagcttt

SEQ ID NO: 1397764 - DNA, 22 bp, Artificial Sequence
  chemically synthesized
gctctgttatgtactgttagag

SEQ ID NO: 1397765 - DNA, 22 bp, Artificial Sequence
  chemically synthesized
ggctctgttatgtactgttaga

SEQ ID NO: 1397766 - DNA, 22 bp, Artificial Sequence
  chemically synthesized
acttggctctgttatgtactgt

SEQ ID NO: 1397767 - DNA, 22 bp, Artificial Sequence
  chemically synthesized
aagctctaacagtacataacag

SEQ ID NO: 1397768 - DNA, 22 bp, Artificial Sequence
  chemically synthesized
aaaagtctgacttggctctgtt

SEQ ID NO: 1397769 - DNA, 22 bp, Artificial Sequence
  chemically synthesized
taacagtacataacagagccaa

SEQ ID NO: 1397770 - DNA, 22 bp, Artificial Sequence
  chemically synthesized
acagtacataacagagccaagt

SEQ ID NO: 1397771 - DNA, 22 bp, Artificial Sequence
  chemically synthesized
aaagaacatataaatattaaaa

SEQ ID NO: 1397772 - DNA, 22 bp, Artificial Sequence
  chemically synthesized
cctaaaagaacatataaatatt

SEQ ID NO: 1397773 - DNA, 22 bp, Artificial Sequence
  chemically synthesized
ccctaaaagaacatataaatat

SEQ ID NO: 1397774 - DNA, 22 bp, Artificial Sequence
  chemically synthesized
tttaatatttatatgttctttt

SEQ ID NO: 1397775 - DNA, 22 bp, Artificial Sequence
  chemically synthesized
ttaatatttatatgttctttta

SEQ ID NO: 1397776 - DNA, 22 bp, Artificial Sequence
  chemically synthesized
taatatttatatgttcttttag

SEQ ID NO: 1397777 - DNA, 22 bp, Artificial Sequence
  chemically synthesized
aatatttatatgttcttttagg

SEQ ID NO: 1397778 - DNA, 22 bp, Artificial Sequence
  chemically synthesized
atatttatatgttcttttaggg

SEQ ID NO: 1397779 - DNA, 22 bp, Artificial Sequence
  chemically synthesized
atatgttcttttagggaaattg

SEQ ID NO: 1397780 - DNA, 22 bp, Artificial Sequence
  chemically synthesized
caggaaccagaacaatttccct

SEQ ID NO: 1397781 - DNA, 22 bp, Artificial Sequence
  chemically synthesized
tatgttcttttagggaaattgt

SEQ ID NO: 1397782 - DNA, 22 bp, Artificial Sequence
  chemically synthesized
ttttagggaaattgttctggtt

SEQ ID NO: 1397783 - DNA, 22 bp, Artificial Sequence
  chemically synthesized
atcatctgcaggaaccagaaca

SEQ ID NO: 1397784 - DNA, 22 bp, Artificial Sequence
  chemically synthesized
ttagggaaattgttctggttcc

SEQ ID NO: 1397785 - DNA, 22 bp, Artificial Sequence
  chemically synthesized
tagggaaattgttctggttcct

SEQ ID NO: 1397786 - DNA, 22 bp, Artificial Sequence
  chemically synthesized
ttaatcatctgcaggaaccaga

SEQ ID NO: 1397787 - DNA, 22 bp, Artificial Sequence
  chemically synthesized
agggaaattgttctggttcctg

SEQ ID NO: 1397788 - DNA, 22 bp, Artificial Sequence
  chemically synthesized
gggaaattgttctggttcctgc

SEQ ID NO: 1397789 - DNA, 22 bp, Artificial Sequence
  chemically synthesized
ttctggttcctgcagatgatta

SEQ ID NO: 1397790 - DNA, 22 bp, Artificial Sequence
  chemically synthesized
tggttcctgcagatgattaata

SEQ ID NO: 1397791 - DNA, 22 bp, Artificial Sequence
  chemically synthesized
gttcctgcagatgattaataat

SEQ ID NO: 1397792 - DNA, 22 bp, Artificial Sequence
  chemically synthesized
ctgcagatgattaataatacct

SEQ ID NO: 1397793 - DNA, 22 bp, Artificial Sequence
  chemically synthesized
tgcaaatgcagcaggtattatt

SEQ ID NO: 1397794 - DNA, 22 bp, Artificial Sequence
  chemically synthesized
cagatgattaataatacctgct

SEQ ID NO: 1397795 - DNA, 22 bp, Artificial Sequence
  chemically synthesized
ataatacctgctgcatttgcat

SEQ ID NO: 1397796 - DNA, 22 bp, Artificial Sequence
  chemically synthesized
acaccgtgaattatgcaaatgc

SEQ ID NO: 1397797 - DNA, 22 bp, Artificial Sequence
  chemically synthesized
aacaccgtgaattatgcaaatg

SEQ ID NO: 1397798 - DNA, 22 bp, Artificial Sequence
  chemically synthesized
tttaacaccgtgaattatgcaa

SEQ ID NO: 1397799 - DNA, 22 bp, Artificial Sequence
  chemically synthesized
attatttaacaccgtgaattat

SEQ ID NO: 1397800 - DNA, 22 bp, Artificial Sequence
  chemically synthesized
ctgcatttgcataattcacggt

SEQ ID NO: 1397801 - DNA, 22 bp, Artificial Sequence
  chemically synthesized
ttaattatttaacaccgtgaat

SEQ ID NO: 1397802 - DNA, 22 bp, Artificial Sequence
  chemically synthesized
catttgcataattcacggtgtt

SEQ ID NO: 1397803 - DNA, 22 bp, Artificial Sequence
  chemically synthesized
gcataattcacggtgttaaata

SEQ ID NO: 1397804 - DNA, 22 bp, Artificial Sequence
  chemically synthesized
cataattcacggtgttaaataa

SEQ ID NO: 1397805 - DNA, 22 bp, Artificial Sequence
  chemically synthesized
taatcctgttaattatttaaca

SEQ ID NO: 1397806 - DNA, 22 bp, Artificial Sequence
  chemically synthesized
acggtgttaaataattaacagg

SEQ ID NO: 1397807 - DNA, 22 bp, Artificial Sequence
  chemically synthesized
tgaatataattataatcctgtt

SEQ ID NO: 1397808 - DNA, 22 bp, Artificial Sequence
  chemically synthesized
aataattaacaggattataatt

SEQ ID NO: 1397809 - DNA, 22 bp, Artificial Sequence
  chemically synthesized
ataaagaattatgaatataatt

SEQ ID NO: 1397810 - DNA, 22 bp, Artificial Sequence
  chemically synthesized
acaggattataattatattcat

SEQ ID NO: 1397811 - DNA, 22 bp, Artificial Sequence
  chemically synthesized
aattgataaagaattatgaata

SEQ ID NO: 1397812 - DNA, 22 bp, Artificial Sequence
  chemically synthesized
caattgataaagaattatgaat

SEQ ID NO: 1397813 - DNA, 22 bp, Artificial Sequence
  chemically synthesized
acttcaattgataaagaattat

SEQ ID NO: 1397814 - DNA, 22 bp, Artificial Sequence
  chemically synthesized
taattatattcataattcttta

SEQ ID NO: 1397815 - DNA, 22 bp, Artificial Sequence
  chemically synthesized
ttaacttcaattgataaagaat

SEQ ID NO: 1397816 - DNA, 22 bp, Artificial Sequence
  chemically synthesized
tattcataattctttatcaatt

SEQ ID NO: 1397817 - DNA, 22 bp, Artificial Sequence
  chemically synthesized
ataattctttatcaattgaagt

SEQ ID NO: 1397818 - DNA, 22 bp, Artificial Sequence
  chemically synthesized
tttatcaattgaagttaataac

SEQ ID NO: 1397819 - DNA, 22 bp, Artificial Sequence
  chemically synthesized
gagcagaccaaagttattaact

SEQ ID NO: 1397820 - DNA, 22 bp, Artificial Sequence
  chemically synthesized
tatcaattgaagttaataactt

SEQ ID NO: 1397821 - DNA, 22 bp, Artificial Sequence
  chemically synthesized
atcaattgaagttaataacttt

SEQ ID NO: 1397822 - DNA, 22 bp, Artificial Sequence
  chemically synthesized
tcaattgaagttaataactttg

SEQ ID NO: 1397823 - DNA, 22 bp, Artificial Sequence
  chemically synthesized
aagttaataactttggtctgct

SEQ ID NO: 1397824 - DNA, 22 bp, Artificial Sequence
  chemically synthesized
ataactttggtctgctctagcg

SEQ ID NO: 1397825 - DNA, 22 bp, Artificial Sequence
  chemically synthesized
aataacatagcgcgctagagca

SEQ ID NO: 1397826 - DNA, 22 bp, Artificial Sequence
  chemically synthesized
gttcaataacatagcgcgctag

SEQ ID NO: 1397827 - DNA, 22 bp, Artificial Sequence
  chemically synthesized
agttcaataacatagcgcgcta

SEQ ID NO: 1397828 - DNA, 22 bp, Artificial Sequence
  chemically synthesized
tggtctgctctagcgcgctatg

SEQ ID NO: 1397829 - DNA, 22 bp, Artificial Sequence
  chemically synthesized
ggtctgctctagcgcgctatgt

SEQ ID NO: 1397830 - DNA, 22 bp, Artificial Sequence
  chemically synthesized
gtctgctctagcgcgctatgtt

SEQ ID NO: 1397831 - DNA, 22 bp, Artificial Sequence
  chemically synthesized
ctctagcgcgctatgttattga

SEQ ID NO: 1397832 - DNA, 22 bp, Artificial Sequence
  chemically synthesized
tagcgcgctatgttattgaact

SEQ ID NO: 1397833 - DNA, 22 bp, Artificial Sequence
  chemically synthesized
aagtacagatcttagttcaata

SEQ ID NO: 1397834 - DNA, 22 bp, Artificial Sequence
  chemically synthesized
gcgcgctatgttattgaactaa

SEQ ID NO: 1397835 - DNA, 22 bp, Artificial Sequence
  chemically synthesized
gaagtacagatcttagttcaat

SEQ ID NO: 1397836 - DNA, 22 bp, Artificial Sequence
  chemically synthesized
tgaagtacagatcttagttcaa

SEQ ID NO: 1397837 - DNA, 22 bp, Artificial Sequence
  chemically synthesized
ttttgaagtacagatcttagtt

SEQ ID NO: 1397838 - DNA, 22 bp, Artificial Sequence
  chemically synthesized
tgttattgaactaagatctgta

SEQ ID NO: 1397839 - DNA, 22 bp, Artificial Sequence
  chemically synthesized
ttgaactaagatctgtacttca

SEQ ID NO: 1397840 - DNA, 22 bp, Artificial Sequence
  chemically synthesized
gaatcattattttgaagtacag

SEQ ID NO: 1397841 - DNA, 22 bp, Artificial Sequence
  chemically synthesized
aactaagatctgtacttcaaaa

SEQ ID NO: 1397842 - DNA, 22 bp, Artificial Sequence
  chemically synthesized
actagaatcattattttgaagt

SEQ ID NO: 1397843 - DNA, 22 bp, Artificial Sequence
  chemically synthesized
agatctgtacttcaaaataatg

SEQ ID NO: 1397844 - DNA, 22 bp, Artificial Sequence
  chemically synthesized
atattaactagaatcattattt

SEQ ID NO: 1397845 - DNA, 22 bp, Artificial Sequence
  chemically synthesized
ctaatattaactagaatcatta

SEQ ID NO: 1397846 - DNA, 22 bp, Artificial Sequence
  chemically synthesized
tacttcaaaataatgattctag

SEQ ID NO: 1397847 - DNA, 22 bp, Artificial Sequence
  chemically synthesized
caaaataatgattctagttaat

SEQ ID NO: 1397848 - DNA, 22 bp, Artificial Sequence
  chemically synthesized
aaaataatgattctagttaata

SEQ ID NO: 1397849 - DNA, 22 bp, Artificial Sequence
  chemically synthesized
gatatgtaatatgtgttgctaa

SEQ ID NO: 1397850 - DNA, 22 bp, Artificial Sequence
  chemically synthesized
tagttaatattagcaacacata

SEQ ID NO: 1397851 - DNA, 22 bp, Artificial Sequence
  chemically synthesized
gttaatattagcaacacatatt

SEQ ID NO: 1397852 - DNA, 22 bp, Artificial Sequence
  chemically synthesized
atattagcaacacatattacat

SEQ ID NO: 1397853 - DNA, 22 bp, Artificial Sequence
  chemically synthesized
gcaacacatattacatatctag

SEQ ID NO: 1397854 - DNA, 22 bp, Artificial Sequence
  chemically synthesized
gggaatataaagaaagggctag

SEQ ID NO: 1397855 - DNA, 22 bp, Artificial Sequence
  chemically synthesized
actggggaatataaagaaaggg

SEQ ID NO: 1397856 - DNA, 22 bp, Artificial Sequence
  chemically synthesized
catatctagccctttctttata

SEQ ID NO: 1397857 - DNA, 22 bp, Artificial Sequence
  chemically synthesized
tcaaagctgactggggaatata

SEQ ID NO: 1397858 - DNA, 22 bp, Artificial Sequence
  chemically synthesized
gtcaaagctgactggggaatat

SEQ ID NO: 1397859 - DNA, 22 bp, Artificial Sequence
  chemically synthesized
gccctttctttatattccccag

SEQ ID NO: 1397860 - DNA, 22 bp, Artificial Sequence
  chemically synthesized
aatttgtcaaagctgactgggg

SEQ ID NO: 1397861 - DNA, 22 bp, Artificial Sequence
  chemically synthesized
tctttatattccccagtcagct

SEQ ID NO: 1397862 - DNA, 22 bp, Artificial Sequence
  chemically synthesized
ctttatattccccagtcagctt

SEQ ID NO: 1397863 - DNA, 22 bp, Artificial Sequence
  chemically synthesized
tttatattccccagtcagcttt

SEQ ID NO: 1397864 - DNA, 22 bp, Artificial Sequence
  chemically synthesized
tatattccccagtcagctttga

SEQ ID NO: 1397865 - DNA, 22 bp, Artificial Sequence
  chemically synthesized
atattccccagtcagctttgac

SEQ ID NO: 1397866 - DNA, 22 bp, Artificial Sequence
  chemically synthesized
tattccccagtcagctttgaca

SEQ ID NO: 1397867 - DNA, 22 bp, Artificial Sequence
  chemically synthesized
aaccatatactcaatttgtcaa

SEQ ID NO: 1397868 - DNA, 22 bp, Artificial Sequence
  chemically synthesized
cccagtcagctttgacaaattg

SEQ ID NO: 1397869 - DNA, 22 bp, Artificial Sequence
  chemically synthesized
aaaccatatactcaatttgtca

SEQ ID NO: 1397870 - DNA, 22 bp, Artificial Sequence
  chemically synthesized
agggacttaaaccatatactca

SEQ ID NO: 1397871 - DNA, 22 bp, Artificial Sequence
  chemically synthesized
tgacaaattgagtatatggttt

SEQ ID NO: 1397872 - DNA, 22 bp, Artificial Sequence
  chemically synthesized
gacaaattgagtatatggttta

SEQ ID NO: 1397873 - DNA, 22 bp, Artificial Sequence
  chemically synthesized
acaaattgagtatatggtttaa

SEQ ID NO: 1397874 - DNA, 22 bp, Artificial Sequence
  chemically synthesized
aatattaagggacttaaaccat

SEQ ID NO: 1397875 - DNA, 22 bp, Artificial Sequence
  chemically synthesized
actgaatattaagggacttaaa

SEQ ID NO: 1397876 - DNA, 22 bp, Artificial Sequence
  chemically synthesized
tcactgaatattaagggactta

SEQ ID NO: 1397877 - DNA, 22 bp, Artificial Sequence
  chemically synthesized
agtatatggtttaagtccctta

SEQ ID NO: 1397878 - DNA, 22 bp, Artificial Sequence
  chemically synthesized
ctcactgaatattaagggactt

SEQ ID NO: 1397879 - DNA, 22 bp, Artificial Sequence
  chemically synthesized
ttctcactgaatattaagggac

SEQ ID NO: 1397880 - DNA, 22 bp, Artificial Sequence
  chemically synthesized
cttctcactgaatattaaggga

SEQ ID NO: 1397881 - DNA, 22 bp, Artificial Sequence
  chemically synthesized
aagtcccttaatattcagtgag

SEQ ID NO: 1397882 - DNA, 22 bp, Artificial Sequence
  chemically synthesized
agtcccttaatattcagtgaga

SEQ ID NO: 1397883 - DNA, 22 bp, Artificial Sequence
  chemically synthesized
aaatgcatttcttctcactgaa

SEQ ID NO: 1397884 - DNA, 22 bp, Artificial Sequence
  chemically synthesized
aaaatgcatttcttctcactga

SEQ ID NO: 1397885 - DNA, 22 bp, Artificial Sequence
  chemically synthesized
taaaatgcatttcttctcactg

SEQ ID NO: 1397886 - DNA, 22 bp, Artificial Sequence
  chemically synthesized
aatattcagtgagaagaaatgc

SEQ ID NO: 1397887 - DNA, 22 bp, Artificial Sequence
  chemically synthesized
atattcagtgagaagaaatgca

SEQ ID NO: 1397888 - DNA, 22 bp, Artificial Sequence
  chemically synthesized
cagattttaaaatgcatttctt

SEQ ID NO: 1397889 - DNA, 22 bp, Artificial Sequence
  chemically synthesized
ccagattttaaaatgcatttct

SEQ ID NO: 1397890 - DNA, 22 bp, Artificial Sequence
  chemically synthesized
agtgagaagaaatgcattttaa

SEQ ID NO: 1397891 - DNA, 22 bp, Artificial Sequence
  chemically synthesized
aatacagacagatttccagatt

SEQ ID NO: 1397892 - DNA, 22 bp, Artificial Sequence
  chemically synthesized
aaatacagacagatttccagat

SEQ ID NO: 1397893 - DNA, 22 bp, Artificial Sequence
  chemically synthesized
tgtttaaatacagacagatttc

SEQ ID NO: 1397894 - DNA, 22 bp, Artificial Sequence
  chemically synthesized
atgtttaaatacagacagattt

SEQ ID NO: 1397895 - DNA, 22 bp, Artificial Sequence
  chemically synthesized
taaaatctggaaatctgtctgt

SEQ ID NO: 1397896 - DNA, 22 bp, Artificial Sequence
  chemically synthesized
aaaatctggaaatctgtctgta

SEQ ID NO: 1397897 - DNA, 22 bp, Artificial Sequence
  chemically synthesized
aaatctggaaatctgtctgtat

SEQ ID NO: 1397898 - DNA, 22 bp, Artificial Sequence
  chemically synthesized
tatttatgtttaaatacagaca

SEQ ID NO: 1397899 - DNA, 22 bp, Artificial Sequence
  chemically synthesized
atatttatgtttaaatacagac

SEQ ID NO: 1397900 - DNA, 22 bp, Artificial Sequence
  chemically synthesized
tttatatttatgtttaaataca

SEQ ID NO: 1397901 - DNA, 22 bp, Artificial Sequence
  chemically synthesized
atttatatttatgtttaaatac

SEQ ID NO: 1397902 - DNA, 22 bp, Artificial Sequence
  chemically synthesized
gaaatctgtctgtatttaaaca

SEQ ID NO: 1397903 - DNA, 22 bp, Artificial Sequence
  chemically synthesized
tttatttatatttatgtttaaa

SEQ ID NO: 1397904 - DNA, 22 bp, Artificial Sequence
  chemically synthesized
atttatttatatttatgtttaa

SEQ ID NO: 1397905 - DNA, 22 bp, Artificial Sequence
  chemically synthesized
atttatttatttatatttatgt

SEQ ID NO: 1397906 - DNA, 22 bp, Artificial Sequence
  chemically synthesized
tctgtatttaaacataaatata

SEQ ID NO: 1397907 - DNA, 22 bp, Artificial Sequence
  chemically synthesized
ttcatttatttatttatattta

SEQ ID NO: 1397908 - DNA, 22 bp, Artificial Sequence
  chemically synthesized
gttcatttatttatttatattt

SEQ ID NO: 1397909 - DNA, 22 bp, Artificial Sequence
  chemically synthesized
tatttaaacataaatataaata

SEQ ID NO: 1397910 - DNA, 22 bp, Artificial Sequence
  chemically synthesized
tttgttcatttatttatttata

SEQ ID NO: 1397911 - DNA, 22 bp, Artificial Sequence
  chemically synthesized
atttgttcatttatttatttat

SEQ ID NO: 1397912 - DNA, 22 bp, Artificial Sequence
  chemically synthesized
aaacataaatataaataaataa

SEQ ID NO: 1397913 - DNA, 22 bp, Artificial Sequence
  chemically synthesized
aacataaatataaataaataaa

SEQ ID NO: 1397914 - DNA, 22 bp, Artificial Sequence
  chemically synthesized
tttatttgttcatttatttatt

SEQ ID NO: 1397915 - DNA, 22 bp, Artificial Sequence
  chemically synthesized
atttatttgttcatttatttat

SEQ ID NO: 1397916 - DNA, 22 bp, Artificial Sequence
  chemically synthesized
tttatttatttgttcatttatt

SEQ ID NO: 1397917 - DNA, 22 bp, Artificial Sequence
  chemically synthesized
atttatttatttgttcatttat

SEQ ID NO: 1397918 - DNA, 22 bp, Artificial Sequence
  chemically synthesized
tatttatttatttgttcattta

SEQ ID NO: 1397919 - DNA, 22 bp, Artificial Sequence
  chemically synthesized
tttatttatttatttgttcatt

SEQ ID NO: 1397920 - DNA, 22 bp, Artificial Sequence
  chemically synthesized
agtatagatataaagctcttta

SEQ ID NO: 1397921 - DNA, 22 bp, Artificial Sequence
  chemically synthesized
tatatctatactgaggtgtata

SEQ ID NO: 1397922 - DNA, 22 bp, Artificial Sequence
  chemically synthesized
atatctatactgaggtgtatac

SEQ ID NO: 1397923 - DNA, 22 bp, Artificial Sequence
  chemically synthesized
tatctatactgaggtgtatacc

SEQ ID NO: 1397924 - DNA, 22 bp, Artificial Sequence
  chemically synthesized
tactgaggtgtataccatatct

SEQ ID NO: 1397925 - DNA, 22 bp, Artificial Sequence
  chemically synthesized
tatatataaagatagatatggt

SEQ ID NO: 1397926 - DNA, 22 bp, Artificial Sequence
  chemically synthesized
aggtgtataccatatctatctt

SEQ ID NO: 1397927 - DNA, 22 bp, Artificial Sequence
  chemically synthesized
tctttatatatatagatatgtg

SEQ ID NO: 1397928 - DNA, 22 bp, Artificial Sequence
  chemically synthesized
tatatatatagatatgtgatat

SEQ ID NO: 1397929 - DNA, 22 bp, Artificial Sequence
  chemically synthesized
cagtaaaaataaatatcacata

SEQ ID NO: 1397930 - DNA, 22 bp, Artificial Sequence
  chemically synthesized
atatatatagatatgtgatatt

SEQ ID NO: 1397931 - DNA, 22 bp, Artificial Sequence
  chemically synthesized
gcagtaaaaataaatatcacat

SEQ ID NO: 1397932 - DNA, 22 bp, Artificial Sequence
  chemically synthesized
tatatatagatatgtgatattt

SEQ ID NO: 1397933 - DNA, 22 bp, Artificial Sequence
  chemically synthesized
tgcagtaaaaataaatatcaca

SEQ ID NO: 1397934 - DNA, 22 bp, Artificial Sequence
  chemically synthesized
tttgcagtaaaaataaatatca

SEQ ID NO: 1397935 - DNA, 22 bp, Artificial Sequence
  chemically synthesized
tctctttgcagtaaaaataaat

SEQ ID NO: 1397936 - DNA, 22 bp, Artificial Sequence
  chemically synthesized
ctatctctttgcagtaaaaata

SEQ ID NO: 1397937 - DNA, 22 bp, Artificial Sequence
  chemically synthesized
actatctctttgcagtaaaaat

SEQ ID NO: 1397938 - DNA, 22 bp, Artificial Sequence
  chemically synthesized
atttttactgcaaagagatagt

SEQ ID NO: 1397939 - DNA, 22 bp, Artificial Sequence
  chemically synthesized
tttttactgcaaagagatagta

SEQ ID NO: 1397940 - DNA, 22 bp, Artificial Sequence
  chemically synthesized
aaataaaaagtttactatctct

SEQ ID NO: 1397941 - DNA, 22 bp, Artificial Sequence
  chemically synthesized
taaaataaaaagtttactatct

SEQ ID NO: 1397942 - DNA, 22 bp, Artificial Sequence
  chemically synthesized
ttactgcaaagagatagtaaac

SEQ ID NO: 1397943 - DNA, 22 bp, Artificial Sequence
  chemically synthesized
tactgcaaagagatagtaaact

SEQ ID NO: 1397944 - DNA, 22 bp, Artificial Sequence
  chemically synthesized
actgcaaagagatagtaaactt

SEQ ID NO: 1397945 - DNA, 22 bp, Artificial Sequence
  chemically synthesized
ttctaaaataaaaagtttacta

SEQ ID NO: 1397946 - DNA, 22 bp, Artificial Sequence
  chemically synthesized
ctgcaaagagatagtaaacttt

SEQ ID NO: 1397947 - DNA, 22 bp, Artificial Sequence
  chemically synthesized
caaagagatagtaaacttttta

SEQ ID NO: 1397948 - DNA, 22 bp, Artificial Sequence
  chemically synthesized
taacctattctaaaataaaaag

SEQ ID NO: 1397949 - DNA, 22 bp, Artificial Sequence
  chemically synthesized
gtaacctattctaaaataaaaa

SEQ ID NO: 1397950 - DNA, 22 bp, Artificial Sequence
  chemically synthesized
cttgtaacctattctaaaataa

SEQ ID NO: 1397951 - DNA, 22 bp, Artificial Sequence
  chemically synthesized
ctacttgtaacctattctaaaa

SEQ ID NO: 1397952 - DNA, 22 bp, Artificial Sequence
  chemically synthesized
cctacttgtaacctattctaaa

SEQ ID NO: 1397953 - DNA, 22 bp, Artificial Sequence
  chemically synthesized
tttcctacttgtaacctattct

SEQ ID NO: 1397954 - DNA, 22 bp, Artificial Sequence
  chemically synthesized
gtttcctacttgtaacctattc

SEQ ID NO: 1397955 - DNA, 22 bp, Artificial Sequence
  chemically synthesized
tttattttagaataggttacaa

SEQ ID NO: 1397956 - DNA, 22 bp, Artificial Sequence
  chemically synthesized
ttattttagaataggttacaag

SEQ ID NO: 1397957 - DNA, 22 bp, Artificial Sequence
  chemically synthesized
tattttagaataggttacaagt

SEQ ID NO: 1397958 - DNA, 22 bp, Artificial Sequence
  chemically synthesized
attttagaataggttacaagta

SEQ ID NO: 1397959 - DNA, 22 bp, Artificial Sequence
  chemically synthesized
ttttagaataggttacaagtag

SEQ ID NO: 1397960 - DNA, 22 bp, Artificial Sequence
  chemically synthesized
agtatatttgtttcctacttgt

SEQ ID NO: 1397961 - DNA, 22 bp, Artificial Sequence
  chemically synthesized
tagaataggttacaagtaggaa

SEQ ID NO: 1397962 - DNA, 22 bp, Artificial Sequence
  chemically synthesized
aagtatatttgtttcctacttg

SEQ ID NO: 1397963 - DNA, 22 bp, Artificial Sequence
  chemically synthesized
agaataggttacaagtaggaaa

SEQ ID NO: 1397964 - DNA, 22 bp, Artificial Sequence
  chemically synthesized
taagtatatttgtttcctactt

SEQ ID NO: 1397965 - DNA, 22 bp, Artificial Sequence
  chemically synthesized
gaataggttacaagtaggaaac

SEQ ID NO: 1397966 - DNA, 22 bp, Artificial Sequence
  chemically synthesized
ttaagtatatttgtttcctact

SEQ ID NO: 1397967 - DNA, 22 bp, Artificial Sequence
  chemically synthesized
tttaagtatatttgtttcctac

SEQ ID NO: 1397968 - DNA, 22 bp, Artificial Sequence
  chemically synthesized
ttttttaagtatatttgtttcc

SEQ ID NO: 1397969 - DNA, 22 bp, Artificial Sequence
  chemically synthesized
ttattttttaagtatatttgtt

SEQ ID NO: 1397970 - DNA, 22 bp, Artificial Sequence
  chemically synthesized
attattttttaagtatatttgt

SEQ ID NO: 1397971 - DNA, 22 bp, Artificial Sequence
  chemically synthesized
tattattttttaagtatatttg

SEQ ID NO: 1397972 - DNA, 22 bp, Artificial Sequence
  chemically synthesized
caagtaggaaacaaatatactt

SEQ ID NO: 1397973 - DNA, 22 bp, Artificial Sequence
  chemically synthesized
tacacctttattattttttaag

SEQ ID NO: 1397974 - DNA, 22 bp, Artificial Sequence
  chemically synthesized
gtacacctttattattttttaa

SEQ ID NO: 1397975 - DNA, 22 bp, Artificial Sequence
  chemically synthesized
catcttgtacacctttattatt

SEQ ID NO: 1397976 - DNA, 22 bp, Artificial Sequence
  chemically synthesized
aaaaaataataaaggtgtacaa

SEQ ID NO: 1397977 - DNA, 22 bp, Artificial Sequence
  chemically synthesized
aaaaataataaaggtgtacaag

SEQ ID NO: 1397978 - DNA, 22 bp, Artificial Sequence
  chemically synthesized
tgcaaatggttgcatcttgtac

SEQ ID NO: 1397979 - DNA, 22 bp, Artificial Sequence
  chemically synthesized
atgcaaatggttgcatcttgta

SEQ ID NO: 1397980 - DNA, 22 bp, Artificial Sequence
  chemically synthesized
tatgcaaatggttgcatcttgt

SEQ ID NO: 1397981 - DNA, 22 bp, Artificial Sequence
  chemically synthesized
gtagattttatgcaaatggttg

SEQ ID NO: 1397982 - DNA, 22 bp, Artificial Sequence
  chemically synthesized
ctggtagattttatgcaaatgg

SEQ ID NO: 1397983 - DNA, 22 bp, Artificial Sequence
  chemically synthesized
gcataaaatctaccagtaggtg

SEQ ID NO: 1397984 - DNA, 22 bp, Artificial Sequence
  chemically synthesized
cataaaatctaccagtaggtgg

SEQ ID NO: 1397985 - DNA, 22 bp, Artificial Sequence
  chemically synthesized
acaaaaggccaatgagtgaccc

SEQ ID NO: 1397986 - DNA, 22 bp, Artificial Sequence
  chemically synthesized
cacaaaaggccaatgagtgacc

SEQ ID NO: 1397987 - DNA, 22 bp, Artificial Sequence
  chemically synthesized
ccagtaggtgggtcactcattg

SEQ ID NO: 1397988 - DNA, 22 bp, Artificial Sequence
  chemically synthesized
ttcacaaaaggccaatgagtga

SEQ ID NO: 1397989 - DNA, 22 bp, Artificial Sequence
  chemically synthesized
aagtaaatatatctcttcacaa

SEQ ID NO: 1397990 - DNA, 22 bp, Artificial Sequence
  chemically synthesized
attggccttttgtgaagagata

SEQ ID NO: 1397991 - DNA, 22 bp, Artificial Sequence
  chemically synthesized
gccttttgtgaagagatatatt

SEQ ID NO: 1397992 - DNA, 22 bp, Artificial Sequence
  chemically synthesized
gtcaggtcctgaagtaaatata

SEQ ID NO: 1397993 - DNA, 22 bp, Artificial Sequence
  chemically synthesized
ttgtgaagagatatatttactt

SEQ ID NO: 1397994 - DNA, 22 bp, Artificial Sequence
  chemically synthesized
tgtgaagagatatatttacttc

SEQ ID NO: 1397995 - DNA, 22 bp, Artificial Sequence
  chemically synthesized
gtgaagagatatatttacttca

SEQ ID NO: 1397996 - DNA, 22 bp, Artificial Sequence
  chemically synthesized
tgaagagatatatttacttcag

SEQ ID NO: 1397997 - DNA, 22 bp, Artificial Sequence
  chemically synthesized
attggtcaggtcctgaagtaaa

SEQ ID NO: 1397998 - DNA, 22 bp, Artificial Sequence
  chemically synthesized
ggctaattggtcaggtcctgaa

SEQ ID NO: 1397999 - DNA, 22 bp, Artificial Sequence
  chemically synthesized
atctaggctaattggtcaggtc

SEQ ID NO: 1398000 - DNA, 22 bp, Artificial Sequence
  chemically synthesized
acttcaggacctgaccaattag

SEQ ID NO: 1398001 - DNA, 22 bp, Artificial Sequence
  chemically synthesized
cttcaggacctgaccaattagc

SEQ ID NO: 1398002 - DNA, 22 bp, Artificial Sequence
  chemically synthesized
caggacctgaccaattagccta

SEQ ID NO: 1398003 - DNA, 22 bp, Artificial Sequence
  chemically synthesized
aggacctgaccaattagcctag

SEQ ID NO: 1398004 - DNA, 22 bp, Artificial Sequence
  chemically synthesized
accaattagcctagatgaatat

SEQ ID NO: 1398005 - DNA, 22 bp, Artificial Sequence
  chemically synthesized
taataaaaatataatattcatc

SEQ ID NO: 1398006 - DNA, 22 bp, Artificial Sequence
  chemically synthesized
gtaataaaaatataatattcat

SEQ ID NO: 1398007 - DNA, 22 bp, Artificial Sequence
  chemically synthesized
gcctagatgaatattatatttt

SEQ ID NO: 1398008 - DNA, 22 bp, Artificial Sequence
  chemically synthesized
gatgaatattatatttttatta

SEQ ID NO: 1398009 - DNA, 22 bp, Artificial Sequence
  chemically synthesized
tatttttattacaagtatgtgg

SEQ ID NO: 1398010 - DNA, 22 bp, Artificial Sequence
  chemically synthesized
ttattacaagtatgtggtgtga

SEQ ID NO: 1398011 - DNA, 22 bp, Artificial Sequence
  chemically synthesized
tattacaagtatgtggtgtgat

SEQ ID NO: 1398012 - DNA, 22 bp, Artificial Sequence
  chemically synthesized
attacaagtatgtggtgtgatt

SEQ ID NO: 1398013 - DNA, 22 bp, Artificial Sequence
  chemically synthesized
taataataatataatcacacca

SEQ ID NO: 1398014 - DNA, 22 bp, Artificial Sequence
  chemically synthesized
ttacaagtatgtggtgtgatta

SEQ ID NO: 1398015 - DNA, 22 bp, Artificial Sequence
  chemically synthesized
gtaataataatataatcacacc

SEQ ID NO: 1398016 - DNA, 22 bp, Artificial Sequence
  chemically synthesized
tgtaataataatataatcacac

SEQ ID NO: 1398017 - DNA, 22 bp, Artificial Sequence
  chemically synthesized
caagtatgtggtgtgattatat

SEQ ID NO: 1398018 - DNA, 22 bp, Artificial Sequence
  chemically synthesized
taattttgtaataataatataa

SEQ ID NO: 1398019 - DNA, 22 bp, Artificial Sequence
  chemically synthesized
ttataattttgtaataataata

SEQ ID NO: 1398020 - DNA, 22 bp, Artificial Sequence
  chemically synthesized
gttataattttgtaataataat

SEQ ID NO: 1398021 - DNA, 22 bp, Artificial Sequence
  chemically synthesized
tgttataattttgtaataataa

SEQ ID NO: 1398022 - DNA, 22 bp, Artificial Sequence
  chemically synthesized
ttgttataattttgtaataata

SEQ ID NO: 1398023 - DNA, 22 bp, Artificial Sequence
  chemically synthesized
tttgttataattttgtaataat

SEQ ID NO: 1398024 - DNA, 22 bp, Artificial Sequence
  chemically synthesized
ttttgttataattttgtaataa

SEQ ID NO: 1398025 - DNA, 22 bp, Artificial Sequence
  chemically synthesized
tttttgttataattttgtaata

SEQ ID NO: 1398026 - DNA, 22 bp, Artificial Sequence
  chemically synthesized
ctttttttgttataattttgta

SEQ ID NO: 1398027 - DNA, 22 bp, Artificial Sequence
  chemically synthesized
tattattattacaaaattataa

SEQ ID NO: 1398028 - DNA, 22 bp, Artificial Sequence
  chemically synthesized
cattactttttttgttataatt

SEQ ID NO: 1398029 - DNA, 22 bp, Artificial Sequence
  chemically synthesized
tacattactttttttgttataa

SEQ ID NO: 1398030 - DNA, 22 bp, Artificial Sequence
  chemically synthesized
ttattacaaaattataacaaaa

SEQ ID NO: 1398031 - DNA, 22 bp, Artificial Sequence
  chemically synthesized
ctacattactttttttgttata

SEQ ID NO: 1398032 - DNA, 22 bp, Artificial Sequence
  chemically synthesized
ttacaaaattataacaaaaaaa

SEQ ID NO: 1398033 - DNA, 22 bp, Artificial Sequence
  chemically synthesized
caaaattataacaaaaaaagta

SEQ ID NO: 1398034 - DNA, 22 bp, Artificial Sequence
  chemically synthesized
tatatagtacttctacattact

SEQ ID NO: 1398035 - DNA, 22 bp, Artificial Sequence
  chemically synthesized
taacaaaaaaagtaatgtagaa

SEQ ID NO: 1398036 - DNA, 22 bp, Artificial Sequence
  chemically synthesized
ctatatatagtacttctacatt

SEQ ID NO: 1398037 - DNA, 22 bp, Artificial Sequence
  chemically synthesized
aaggcctcctatatatagtact

SEQ ID NO: 1398038 - DNA, 22 bp, Artificial Sequence
  chemically synthesized
tatataggaggccttcagcttg

SEQ ID NO: 1398039 - DNA, 22 bp, Artificial Sequence
  chemically synthesized
atggaagtatgagtaagggata

SEQ ID NO: 1398040 - DNA, 22 bp, Artificial Sequence
  chemically synthesized
gatggaagtatgagtaagggat

SEQ ID NO: 1398041 - DNA, 22 bp, Artificial Sequence
  chemically synthesized
tgatggaagtatgagtaaggga

SEQ ID NO: 1398042 - DNA, 22 bp, Artificial Sequence
  chemically synthesized
ttgatggaagtatgagtaaggg

SEQ ID NO: 1398043 - DNA, 22 bp, Artificial Sequence
  chemically synthesized
cagcttgtatcccttactcata

SEQ ID NO: 1398044 - DNA, 22 bp, Artificial Sequence
  chemically synthesized
agcttgtatcccttactcatac

SEQ ID NO: 1398045 - DNA, 22 bp, Artificial Sequence
  chemically synthesized
atttttgatggaagtatgagta

SEQ ID NO: 1398046 - DNA, 22 bp, Artificial Sequence
  chemically synthesized
catttttgatggaagtatgagt

SEQ ID NO: 1398047 - DNA, 22 bp, Artificial Sequence
  chemically synthesized
gtatcccttactcatacttcca

SEQ ID NO: 1398048 - DNA, 22 bp, Artificial Sequence
  chemically synthesized
tatcccttactcatacttccat

SEQ ID NO: 1398049 - DNA, 22 bp, Artificial Sequence
  chemically synthesized
tgcttcatttttgatggaagta

SEQ ID NO: 1398050 - DNA, 22 bp, Artificial Sequence
  chemically synthesized
tatgcttcatttttgatggaag

SEQ ID NO: 1398051 - DNA, 22 bp, Artificial Sequence
  chemically synthesized
ctatgcttcatttttgatggaa

SEQ ID NO: 1398052 - DNA, 22 bp, Artificial Sequence
  chemically synthesized
actcatacttccatcaaaaatg

SEQ ID NO: 1398053 - DNA, 22 bp, Artificial Sequence
  chemically synthesized
ctcatacttccatcaaaaatga

SEQ ID NO: 1398054 - DNA, 22 bp, Artificial Sequence
  chemically synthesized
atacttccatcaaaaatgaagc

SEQ ID NO: 1398055 - DNA, 22 bp, Artificial Sequence
  chemically synthesized
caaatacttctatgcttcattt

SEQ ID NO: 1398056 - DNA, 22 bp, Artificial Sequence
  chemically synthesized
ccatcaaaaatgaagcatagaa

SEQ ID NO: 1398057 - DNA, 22 bp, Artificial Sequence
  chemically synthesized
catcaaaaatgaagcatagaag

SEQ ID NO: 1398058 - DNA, 22 bp, Artificial Sequence
  chemically synthesized
aaataaatcaatactccaaata

SEQ ID NO: 1398059 - DNA, 22 bp, Artificial Sequence
  chemically synthesized
atgaatgactaaaataaatcaa

SEQ ID NO: 1398060 - DNA, 22 bp, Artificial Sequence
  chemically synthesized
ggagtattgatttattttagtc

SEQ ID NO: 1398061 - DNA, 22 bp, Artificial Sequence
  chemically synthesized
gagtattgatttattttagtca

SEQ ID NO: 1398062 - DNA, 22 bp, Artificial Sequence
  chemically synthesized
atttattttagtcattcattag

SEQ ID NO: 1398063 - DNA, 22 bp, Artificial Sequence
  chemically synthesized
attttagtcattcattagctat

SEQ ID NO: 1398064 - DNA, 22 bp, Artificial Sequence
  chemically synthesized
ttttagtcattcattagctatc

SEQ ID NO: 1398065 - DNA, 22 bp, Artificial Sequence
  chemically synthesized
tagtcattcattagctatcatg

SEQ ID NO: 1398066 - DNA, 22 bp, Artificial Sequence
  chemically synthesized
agtcattcattagctatcatgg

SEQ ID NO: 1398067 - DNA, 22 bp, Artificial Sequence
  chemically synthesized
gtcattcattagctatcatggt

SEQ ID NO: 1398068 - DNA, 22 bp, Artificial Sequence
  chemically synthesized
agacatggataagaccatgata

SEQ ID NO: 1398069 - DNA, 22 bp, Artificial Sequence
  chemically synthesized
cagacatggataagaccatgat

SEQ ID NO: 1398070 - DNA, 22 bp, Artificial Sequence
  chemically synthesized
tcagacatggataagaccatga

SEQ ID NO: 1398071 - DNA, 22 bp, Artificial Sequence
  chemically synthesized
attagctatcatggtcttatcc

SEQ ID NO: 1398072 - DNA, 22 bp, Artificial Sequence
  chemically synthesized
attttcagacatggataagacc

SEQ ID NO: 1398073 - DNA, 22 bp, Artificial Sequence
  chemically synthesized
gattttcagacatggataagac

SEQ ID NO: 1398074 - DNA, 22 bp, Artificial Sequence
  chemically synthesized
gctatcatggtcttatccatgt

SEQ ID NO: 1398075 - DNA, 22 bp, Artificial Sequence
  chemically synthesized
catttgattttcagacatggat

SEQ ID NO: 1398076 - DNA, 22 bp, Artificial Sequence
  chemically synthesized
gcatttgattttcagacatgga

SEQ ID NO: 1398077 - DNA, 22 bp, Artificial Sequence
  chemically synthesized
tcatggtcttatccatgtctga

SEQ ID NO: 1398078 - DNA, 22 bp, Artificial Sequence
  chemically synthesized
atccatgtctgaaaatcaaatg

SEQ ID NO: 1398079 - DNA, 22 bp, Artificial Sequence
  chemically synthesized
aagtacatcttgcatttgattt

SEQ ID NO: 1398080 - DNA, 22 bp, Artificial Sequence
  chemically synthesized
tccatgtctgaaaatcaaatgc

SEQ ID NO: 1398081 - DNA, 22 bp, Artificial Sequence
  chemically synthesized
actaaagtacatcttgcatttg

SEQ ID NO: 1398082 - DNA, 22 bp, Artificial Sequence
  chemically synthesized
cactaaagtacatcttgcattt

SEQ ID NO: 1398083 - DNA, 22 bp, Artificial Sequence
  chemically synthesized
ttcactaaagtacatcttgcat

SEQ ID NO: 1398084 - DNA, 22 bp, Artificial Sequence
  chemically synthesized
aaaatcaaatgcaagatgtact

SEQ ID NO: 1398085 - DNA, 22 bp, Artificial Sequence
  chemically synthesized
cattcttcactaaagtacatct

SEQ ID NO: 1398086 - DNA, 22 bp, Artificial Sequence
  chemically synthesized
ttgcattcttcactaaagtaca

SEQ ID NO: 1398087 - DNA, 22 bp, Artificial Sequence
  chemically synthesized
attgcattcttcactaaagtac

SEQ ID NO: 1398088 - DNA, 22 bp, Artificial Sequence
  chemically synthesized
tattgcattcttcactaaagta

SEQ ID NO: 1398089 - DNA, 22 bp, Artificial Sequence
  chemically synthesized
ttattgcattcttcactaaagt

SEQ ID NO: 1398090 - DNA, 22 bp, Artificial Sequence
  chemically synthesized
atttttattgcattcttcacta

SEQ ID NO: 1398091 - DNA, 22 bp, Artificial Sequence
  chemically synthesized
tagtgaagaatgcaataaaaat

SEQ ID NO: 1398092 - DNA, 22 bp, Artificial Sequence
  chemically synthesized
agtgaagaatgcaataaaaatt

SEQ ID NO: 1398093 - DNA, 22 bp, Artificial Sequence
  chemically synthesized
gtgaagaatgcaataaaaatta

SEQ ID NO: 1398094 - DNA, 22 bp, Artificial Sequence
  chemically synthesized
ccccacaagcacagatattaat

SEQ ID NO: 1398095 - DNA, 22 bp, Artificial Sequence
  chemically synthesized
ttaccccacaagcacagatatt

SEQ ID NO: 1398096 - DNA, 22 bp, Artificial Sequence
  chemically synthesized
gttaccccacaagcacagatat

SEQ ID NO: 1398097 - DNA, 22 bp, Artificial Sequence
  chemically synthesized
tgttaccccacaagcacagata

SEQ ID NO: 1398098 - DNA, 22 bp, Artificial Sequence
  chemically synthesized
actttgttaccccacaagcaca

SEQ ID NO: 1398099 - DNA, 22 bp, Artificial Sequence
  chemically synthesized
aactttgttaccccacaagcac

SEQ ID NO: 1398100 - DNA, 22 bp, Artificial Sequence
  chemically synthesized
taactttgttaccccacaagca

SEQ ID NO: 1398101 - DNA, 22 bp, Artificial Sequence
  chemically synthesized
gttttaactttgttaccccaca

SEQ ID NO: 1398102 - DNA, 22 bp, Artificial Sequence
  chemically synthesized
atatctgtgcttgtggggtaac

SEQ ID NO: 1398103 - DNA, 22 bp, Artificial Sequence
  chemically synthesized
ggttttaactttgttaccccac

SEQ ID NO: 1398104 - DNA, 22 bp, Artificial Sequence
  chemically synthesized
tgcttgtggggtaacaaagtta

SEQ ID NO: 1398105 - DNA, 22 bp, Artificial Sequence
  chemically synthesized
gtggggtaacaaagttaaaacc

SEQ ID NO: 1398106 - DNA, 22 bp, Artificial Sequence
  chemically synthesized
tggggtaacaaagttaaaacca

SEQ ID NO: 1398107 - DNA, 22 bp, Artificial Sequence
  chemically synthesized
agtagaaaaaggtgccttggtt

SEQ ID NO: 1398108 - DNA, 22 bp, Artificial Sequence
  chemically synthesized
cagtagaaaaaggtgccttggt

SEQ ID NO: 1398109 - DNA, 22 bp, Artificial Sequence
  chemically synthesized
tcagtagaaaaaggtgccttgg

SEQ ID NO: 1398110 - DNA, 22 bp, Artificial Sequence
  chemically synthesized
ttcagtagaaaaaggtgccttg

SEQ ID NO: 1398111 - DNA, 22 bp, Artificial Sequence
  chemically synthesized
aaaccaaggcacctttttctac

SEQ ID NO: 1398112 - DNA, 22 bp, Artificial Sequence
  chemically synthesized
atacaccttttcagtagaaaaa

SEQ ID NO: 1398113 - DNA, 22 bp, Artificial Sequence
  chemically synthesized
attcatacaccttttcagtaga

SEQ ID NO: 1398114 - DNA, 22 bp, Artificial Sequence
  chemically synthesized
aattcatacaccttttcagtag

SEQ ID NO: 1398115 - DNA, 22 bp, Artificial Sequence
  chemically synthesized
taattcatacaccttttcagta

SEQ ID NO: 1398116 - DNA, 22 bp, Artificial Sequence
  chemically synthesized
ttttaattcatacaccttttca

SEQ ID NO: 1398117 - DNA, 22 bp, Artificial Sequence
  chemically synthesized
ttattttaattcatacaccttt

SEQ ID NO: 1398118 - DNA, 22 bp, Artificial Sequence
  chemically synthesized
tttctactgaaaaggtgtatga

SEQ ID NO: 1398119 - DNA, 22 bp, Artificial Sequence
  chemically synthesized
ttctactgaaaaggtgtatgaa

SEQ ID NO: 1398120 - DNA, 22 bp, Artificial Sequence
  chemically synthesized
ttgttattttaattcatacacc

SEQ ID NO: 1398121 - DNA, 22 bp, Artificial Sequence
  chemically synthesized
tctactgaaaaggtgtatgaat

SEQ ID NO: 1398122 - DNA, 22 bp, Artificial Sequence
  chemically synthesized
ctactgaaaaggtgtatgaatt

SEQ ID NO: 1398123 - DNA, 22 bp, Artificial Sequence
  chemically synthesized
tactgaaaaggtgtatgaatta

SEQ ID NO: 1398124 - DNA, 22 bp, Artificial Sequence
  chemically synthesized
ttgttgttattttaattcatac

SEQ ID NO: 1398125 - DNA, 22 bp, Artificial Sequence
  chemically synthesized
gttgttgttattttaattcata

SEQ ID NO: 1398126 - DNA, 22 bp, Artificial Sequence
  chemically synthesized
ctgaaaaggtgtatgaattaaa

SEQ ID NO: 1398127 - DNA, 22 bp, Artificial Sequence
  chemically synthesized
tgttgttgttattttaattcat

SEQ ID NO: 1398128 - DNA, 22 bp, Artificial Sequence
  chemically synthesized
ttgttgttgttattttaattca

SEQ ID NO: 1398129 - DNA, 22 bp, Artificial Sequence
  chemically synthesized
tttgttgttgttattttaattc

SEQ ID NO: 1398130 - DNA, 22 bp, Artificial Sequence
  chemically synthesized
aaaaggtgtatgaattaaaata

SEQ ID NO: 1398131 - DNA, 22 bp, Artificial Sequence
  chemically synthesized
tatagtagttttttgttgttgt

SEQ ID NO: 1398132 - DNA, 22 bp, Artificial Sequence
  chemically synthesized
aattatatagtagttttttgtt

SEQ ID NO: 1398133 - DNA, 22 bp, Artificial Sequence
  chemically synthesized
aaataacaacaacaaaaaacta

SEQ ID NO: 1398134 - DNA, 22 bp, Artificial Sequence
  chemically synthesized
aatggagactgaattatatagt

SEQ ID NO: 1398135 - DNA, 22 bp, Artificial Sequence
  chemically synthesized
gaatggagactgaattatatag

SEQ ID NO: 1398136 - DNA, 22 bp, Artificial Sequence
  chemically synthesized
tttgaatggagactgaattata

SEQ ID NO: 1398137 - DNA, 22 bp, Artificial Sequence
  chemically synthesized
taagttatttgaatggagactg

SEQ ID NO: 1398138 - DNA, 22 bp, Artificial Sequence
  chemically synthesized
ataagttatttgaatggagact

SEQ ID NO: 1398139 - DNA, 22 bp, Artificial Sequence
  chemically synthesized
ctatataattcagtctccattc

SEQ ID NO: 1398140 - DNA, 22 bp, Artificial Sequence
  chemically synthesized
tataagttatttgaatggagac

SEQ ID NO: 1398141 - DNA, 22 bp, Artificial Sequence
  chemically synthesized
tataattcagtctccattcaaa

SEQ ID NO: 1398142 - DNA, 22 bp, Artificial Sequence
  chemically synthesized
ttttataagttatttgaatgga

SEQ ID NO: 1398143 - DNA, 22 bp, Artificial Sequence
  chemically synthesized
agtctccattcaaataacttat

SEQ ID NO: 1398144 - DNA, 22 bp, Artificial Sequence
  chemically synthesized
cattcaaataacttataaaata

SEQ ID NO: 1398145 - DNA, 22 bp, Artificial Sequence
  chemically synthesized
aagaaaacatccaagctatttt

SEQ ID NO: 1398146 - DNA, 22 bp, Artificial Sequence
  chemically synthesized
aaataacttataaaatagcttg

SEQ ID NO: 1398147 - DNA, 22 bp, Artificial Sequence
  chemically synthesized
caagaaaacatccaagctattt

SEQ ID NO: 1398148 - DNA, 22 bp, Artificial Sequence
  chemically synthesized
atgtttcaagaaaacatccaag

SEQ ID NO: 1398149 - DNA, 22 bp, Artificial Sequence
  chemically synthesized
ataaaatagcttggatgttttc

SEQ ID NO: 1398150 - DNA, 22 bp, Artificial Sequence
  chemically synthesized
taaaatagcttggatgttttct

SEQ ID NO: 1398151 - DNA, 22 bp, Artificial Sequence
  chemically synthesized
ataatattgatgtttcaagaaa

SEQ ID NO: 1398152 - DNA, 22 bp, Artificial Sequence
  chemically synthesized
aataatattgatgtttcaagaa

SEQ ID NO: 1398153 - DNA, 22 bp, Artificial Sequence
  chemically synthesized
ttaataatattgatgtttcaag

SEQ ID NO: 1398154 - DNA, 22 bp, Artificial Sequence
  chemically synthesized
cttaataatattgatgtttcaa

SEQ ID NO: 1398155 - DNA, 22 bp, Artificial Sequence
  chemically synthesized
ggatgttttcttgaaacatcaa

SEQ ID NO: 1398156 - DNA, 22 bp, Artificial Sequence
  chemically synthesized
gatgttttcttgaaacatcaat

SEQ ID NO: 1398157 - DNA, 22 bp, Artificial Sequence
  chemically synthesized
gaatatcttcttaataatattg

SEQ ID NO: 1398158 - DNA, 22 bp, Artificial Sequence
  chemically synthesized
tcttgaaacatcaatattatta

SEQ ID NO: 1398159 - DNA, 22 bp, Artificial Sequence
  chemically synthesized
cttgaaacatcaatattattaa

SEQ ID NO: 1398160 - DNA, 22 bp, Artificial Sequence
  chemically synthesized
ttgaaacatcaatattattaag

SEQ ID NO: 1398161 - DNA, 22 bp, Artificial Sequence
  chemically synthesized
gaaacatcaatattattaagaa

SEQ ID NO: 1398162 - DNA, 22 bp, Artificial Sequence
  chemically synthesized
tattggaatatcttcttaataa

SEQ ID NO: 1398163 - DNA, 22 bp, Artificial Sequence
  chemically synthesized
aaacatcaatattattaagaag

SEQ ID NO: 1398164 - DNA, 22 bp, Artificial Sequence
  chemically synthesized
tgtattggaatatcttcttaat

SEQ ID NO: 1398165 - DNA, 22 bp, Artificial Sequence
  chemically synthesized
ctgtattggaatatcttcttaa

SEQ ID NO: 1398166 - DNA, 22 bp, Artificial Sequence
  chemically synthesized
tttctgtattggaatatcttct

SEQ ID NO: 1398167 - DNA, 22 bp, Artificial Sequence
  chemically synthesized
ttaagaagatattccaatacag

SEQ ID NO: 1398168 - DNA, 22 bp, Artificial Sequence
  chemically synthesized
agaagatattccaatacagaaa

SEQ ID NO: 1398169 - DNA, 22 bp, Artificial Sequence
  chemically synthesized
tacagaataaattatttctgta

SEQ ID NO: 1398170 - DNA, 22 bp, Artificial Sequence
  chemically synthesized
atacagaataaattatttctgt

SEQ ID NO: 1398171 - DNA, 22 bp, Artificial Sequence
  chemically synthesized
caatacagaaataatttattct

SEQ ID NO: 1398172 - DNA, 22 bp, Artificial Sequence
  chemically synthesized
agtacggtttatacagaataaa

SEQ ID NO: 1398173 - DNA, 22 bp, Artificial Sequence
  chemically synthesized
aagtacggtttatacagaataa

SEQ ID NO: 1398174 - DNA, 22 bp, Artificial Sequence
  chemically synthesized
taagtacggtttatacagaata

SEQ ID NO: 1398175 - DNA, 22 bp, Artificial Sequence
  chemically synthesized
ttaagtacggtttatacagaat

SEQ ID NO: 1398176 - DNA, 22 bp, Artificial Sequence
  chemically synthesized
catgcatttttaagtacggttt

SEQ ID NO: 1398177 - DNA, 22 bp, Artificial Sequence
  chemically synthesized
attctgtataaaccgtacttaa

SEQ ID NO: 1398178 - DNA, 22 bp, Artificial Sequence
  chemically synthesized
ttctgtataaaccgtacttaaa

SEQ ID NO: 1398179 - DNA, 22 bp, Artificial Sequence
  chemically synthesized
tgtataaaccgtacttaaaaat

SEQ ID NO: 1398180 - DNA, 22 bp, Artificial Sequence
  chemically synthesized
tataaaccgtacttaaaaatgc

SEQ ID NO: 1398181 - DNA, 22 bp, Artificial Sequence
  chemically synthesized
caataggctccatgcattttta

SEQ ID NO: 1398182 - DNA, 22 bp, Artificial Sequence
  chemically synthesized
ggcagctacaataggctccatg

SEQ ID NO: 1398183 - DNA, 22 bp, Artificial Sequence
  chemically synthesized
aaaaatgcatggagcctattgt

SEQ ID NO: 1398184 - DNA, 22 bp, Artificial Sequence
  chemically synthesized
aaaatgcatggagcctattgta

SEQ ID NO: 1398185 - DNA, 22 bp, Artificial Sequence
  chemically synthesized
caaaaccattaggcagctacaa

SEQ ID NO: 1398186 - DNA, 22 bp, Artificial Sequence
  chemically synthesized
ttgtagctgcctaatggttttg

SEQ ID NO: 1398187 - DNA, 22 bp, Artificial Sequence
  chemically synthesized
aacaaaaatattacaaaaccat

SEQ ID NO: 1398188 - DNA, 22 bp, Artificial Sequence
  chemically synthesized
caacaaaaatattacaaaacca

SEQ ID NO: 1398189 - DNA, 22 bp, Artificial Sequence
  chemically synthesized
tagctgcctaatggttttgtaa

SEQ ID NO: 1398190 - DNA, 22 bp, Artificial Sequence
  chemically synthesized
cctaatggttttgtaatatttt

SEQ ID NO: 1398191 - DNA, 22 bp, Artificial Sequence
  chemically synthesized
agccacttcaacaaaaatatta

SEQ ID NO: 1398192 - DNA, 22 bp, Artificial Sequence
  chemically synthesized
aagccacttcaacaaaaatatt

SEQ ID NO: 1398193 - DNA, 22 bp, Artificial Sequence
  chemically synthesized
atggttttgtaatatttttgtt

SEQ ID NO: 1398194 - DNA, 22 bp, Artificial Sequence
  chemically synthesized
tacttaagccacttcaacaaaa

SEQ ID NO: 1398195 - DNA, 22 bp, Artificial Sequence
  chemically synthesized
gtacttaagccacttcaacaaa

SEQ ID NO: 1398196 - DNA, 22 bp, Artificial Sequence
  chemically synthesized
tgtacttaagccacttcaacaa

SEQ ID NO: 1398197 - DNA, 22 bp, Artificial Sequence
  chemically synthesized
tgtaatatttttgttgaagtgg

SEQ ID NO: 1398198 - DNA, 22 bp, Artificial Sequence
  chemically synthesized
gtaatatttttgttgaagtggc

SEQ ID NO: 1398199 - DNA, 22 bp, Artificial Sequence
  chemically synthesized
taatatttttgttgaagtggct

SEQ ID NO: 1398200 - DNA, 22 bp, Artificial Sequence
  chemically synthesized
aacctttgtacttaagccactt

SEQ ID NO: 1398201 - DNA, 22 bp, Artificial Sequence
  chemically synthesized
ttgttgaagtggcttaagtaca

SEQ ID NO: 1398202 - DNA, 22 bp, Artificial Sequence
  chemically synthesized
tgttgaagtggcttaagtacaa

SEQ ID NO: 1398203 - DNA, 22 bp, Artificial Sequence
  chemically synthesized
gttgaagtggcttaagtacaaa

SEQ ID NO: 1398204 - DNA, 22 bp, Artificial Sequence
  chemically synthesized
ttgaagtggcttaagtacaaag

SEQ ID NO: 1398205 - DNA, 22 bp, Artificial Sequence
  chemically synthesized
aagtggcttaagtacaaaggtt

SEQ ID NO: 1398206 - DNA, 22 bp, Artificial Sequence
  chemically synthesized
taataagcaattaaacctttgt

SEQ ID NO: 1398207 - DNA, 22 bp, Artificial Sequence
  chemically synthesized
ataataagcaattaaacctttg

SEQ ID NO: 1398208 - DNA, 22 bp, Artificial Sequence
  chemically synthesized
tataataagcaattaaaccttt

SEQ ID NO: 1398209 - DNA, 22 bp, Artificial Sequence
  chemically synthesized
ttataataagcaattaaacctt

SEQ ID NO: 1398210 - DNA, 22 bp, Artificial Sequence
  chemically synthesized
aagtacaaaggtttaattgctt

SEQ ID NO: 1398211 - DNA, 22 bp, Artificial Sequence
  chemically synthesized
gtcttttataataagcaattaa

SEQ ID NO: 1398212 - DNA, 22 bp, Artificial Sequence
  chemically synthesized
agtacaaaggtttaattgctta

SEQ ID NO: 1398213 - DNA, 22 bp, Artificial Sequence
  chemically synthesized
agtcttttataataagcaatta

SEQ ID NO: 1398214 - DNA, 22 bp, Artificial Sequence
  chemically synthesized
aattgcttattataaaagacta

SEQ ID NO: 1398215 - DNA, 22 bp, Artificial Sequence
  chemically synthesized
atataaaatatttagtctttta

SEQ ID NO: 1398216 - DNA, 22 bp, Artificial Sequence
  chemically synthesized
attgcttattataaaagactaa

SEQ ID NO: 1398217 - DNA, 22 bp, Artificial Sequence
  chemically synthesized
attgatataaaatatttagtct

SEQ ID NO: 1398218 - DNA, 22 bp, Artificial Sequence
  chemically synthesized
cttattataaaagactaaatat

SEQ ID NO: 1398219 - DNA, 22 bp, Artificial Sequence
  chemically synthesized
attataaaagactaaatatttt

SEQ ID NO: 1398220 - DNA, 22 bp, Artificial Sequence
  chemically synthesized
attcattgatataaaatattta

SEQ ID NO: 1398221 - DNA, 22 bp, Artificial Sequence
  chemically synthesized
ttataaaagactaaatatttta

SEQ ID NO: 1398222 - DNA, 22 bp, Artificial Sequence
  chemically synthesized
aattcattgatataaaatattt

SEQ ID NO: 1398223 - DNA, 22 bp, Artificial Sequence
  chemically synthesized
taaaagactaaatattttatat

SEQ ID NO: 1398224 - DNA, 22 bp, Artificial Sequence
  chemically synthesized
aatttaattcattgatataaaa

SEQ ID NO: 1398225 - DNA, 22 bp, Artificial Sequence
  chemically synthesized
aaatttaattcattgatataaa

SEQ ID NO: 1398226 - DNA, 22 bp, Artificial Sequence
  chemically synthesized
taaatttaattcattgatataa

SEQ ID NO: 1398227 - DNA, 22 bp, Artificial Sequence
  chemically synthesized
ttaaatttaattcattgatata

SEQ ID NO: 1398228 - DNA, 22 bp, Artificial Sequence
  chemically synthesized
tttaaatttaattcattgatat

SEQ ID NO: 1398229 - DNA, 22 bp, Artificial Sequence
  chemically synthesized
aatattttatatcaatgaatta

SEQ ID NO: 1398230 - DNA, 22 bp, Artificial Sequence
  chemically synthesized
tatatcaatgaattaaatttaa

SEQ ID NO: 1398231 - DNA, 22 bp, Artificial Sequence
  chemically synthesized
atatcaatgaattaaatttaaa

SEQ ID NO: 1398232 - DNA, 22 bp, Artificial Sequence
  chemically synthesized
tatcaatgaattaaatttaaaa

SEQ ID NO: 1398233 - DNA, 22 bp, Artificial Sequence
  chemically synthesized
tggtaatggcagatatttttta

SEQ ID NO: 1398234 - DNA, 22 bp, Artificial Sequence
  chemically synthesized
ttgtggtaatggcagatatttt

SEQ ID NO: 1398235 - DNA, 22 bp, Artificial Sequence
  chemically synthesized
aatttaaaaaatatctgccatt

SEQ ID NO: 1398236 - DNA, 22 bp, Artificial Sequence
  chemically synthesized
gactattgtggtaatggcagat

SEQ ID NO: 1398237 - DNA, 22 bp, Artificial Sequence
  chemically synthesized
aaaaaatatctgccattaccac

SEQ ID NO: 1398238 - DNA, 22 bp, Artificial Sequence
  chemically synthesized
aaaaatatctgccattaccaca

SEQ ID NO: 1398239 - DNA, 22 bp, Artificial Sequence
  chemically synthesized
caacccactggactattgtggt

SEQ ID NO: 1398240 - DNA, 22 bp, Artificial Sequence
  chemically synthesized
tctgcaacccactggactattg

SEQ ID NO: 1398241 - DNA, 22 bp, Artificial Sequence
  chemically synthesized
ccattaccacaatagtccagtg

SEQ ID NO: 1398242 - DNA, 22 bp, Artificial Sequence
  chemically synthesized
agattatctgcaacccactgga

SEQ ID NO: 1398243 - DNA, 22 bp, Artificial Sequence
  chemically synthesized
ccacaatagtccagtgggttgc

SEQ ID NO: 1398244 - DNA, 22 bp, Artificial Sequence
  chemically synthesized
actcagattatctgcaacccac

SEQ ID NO: 1398245 - DNA, 22 bp, Artificial Sequence
  chemically synthesized
aattgactcagattatctgcaa

SEQ ID NO: 1398246 - DNA, 22 bp, Artificial Sequence
  chemically synthesized
ataagagagttaaattgactca

SEQ ID NO: 1398247 - DNA, 22 bp, Artificial Sequence
  chemically synthesized
gataagagagttaaattgactc

SEQ ID NO: 1398248 - DNA, 22 bp, Artificial Sequence
  chemically synthesized
cagataatctgagtcaatttaa

SEQ ID NO: 1398249 - DNA, 22 bp, Artificial Sequence
  chemically synthesized
ttgataagagagttaaattgac

SEQ ID NO: 1398250 - DNA, 22 bp, Artificial Sequence
  chemically synthesized
agtcaatttaactctcttatca

SEQ ID NO: 1398251 - DNA, 22 bp, Artificial Sequence
  chemically synthesized
ggcagaatctcttgataagaga

SEQ ID NO: 1398252 - DNA, 22 bp, Artificial Sequence
  chemically synthesized
tgggcagaatctcttgataaga

SEQ ID NO: 1398253 - DNA, 22 bp, Artificial Sequence
  chemically synthesized
ctgggcagaatctcttgataag

SEQ ID NO: 1398254 - DNA, 22 bp, Artificial Sequence
  chemically synthesized
tctgggcagaatctcttgataa

SEQ ID NO: 1398255 - DNA, 22 bp, Artificial Sequence
  chemically synthesized
attttctgggcagaatctcttg

SEQ ID NO: 1398256 - DNA, 22 bp, Artificial Sequence
  chemically synthesized
aactctcttatcaagagattct

SEQ ID NO: 1398257 - DNA, 22 bp, Artificial Sequence
  chemically synthesized
actctcttatcaagagattctg

SEQ ID NO: 1398258 - DNA, 22 bp, Artificial Sequence
  chemically synthesized
ctaattttctgggcagaatctc

SEQ ID NO: 1398259 - DNA, 22 bp, Artificial Sequence
  chemically synthesized
tcttatcaagagattctgccca

SEQ ID NO: 1398260 - DNA, 22 bp, Artificial Sequence
  chemically synthesized
ttatcaagagattctgcccaga

SEQ ID NO: 1398261 - DNA, 22 bp, Artificial Sequence
  chemically synthesized
atcaagagattctgcccagaaa

SEQ ID NO: 1398262 - DNA, 22 bp, Artificial Sequence
  chemically synthesized
tcaagagattctgcccagaaaa

SEQ ID NO: 1398263 - DNA, 22 bp, Artificial Sequence
  chemically synthesized
agaacataataatggttgctaa

SEQ ID NO: 1398264 - DNA, 22 bp, Artificial Sequence
  chemically synthesized
tgcccagaaaattagcaaccat

SEQ ID NO: 1398265 - DNA, 22 bp, Artificial Sequence
  chemically synthesized
cagaacataataatggttgcta

SEQ ID NO: 1398266 - DNA, 22 bp, Artificial Sequence
  chemically synthesized
tcagaacataataatggttgct

SEQ ID NO: 1398267 - DNA, 22 bp, Artificial Sequence
  chemically synthesized
cccagaaaattagcaaccatta

SEQ ID NO: 1398268 - DNA, 22 bp, Artificial Sequence
  chemically synthesized
tttcagaacataataatggttg

SEQ ID NO: 1398269 - DNA, 22 bp, Artificial Sequence
  chemically synthesized
tgttctttcagaacataataat

SEQ ID NO: 1398270 - DNA, 22 bp, Artificial Sequence
  chemically synthesized
gtgttctttcagaacataataa

SEQ ID NO: 1398271 - DNA, 22 bp, Artificial Sequence
  chemically synthesized
tgtgttctttcagaacataata

SEQ ID NO: 1398272 - DNA, 22 bp, Artificial Sequence
  chemically synthesized
ttgtgttctttcagaacataat

SEQ ID NO: 1398273 - DNA, 22 bp, Artificial Sequence
  chemically synthesized
gcaaccattattatgttctgaa

SEQ ID NO: 1398274 - DNA, 22 bp, Artificial Sequence
  chemically synthesized
tagaccttttgtgttctttcag

SEQ ID NO: 1398275 - DNA, 22 bp, Artificial Sequence
  chemically synthesized
ttatagaccttttgtgttcttt

SEQ ID NO: 1398276 - DNA, 22 bp, Artificial Sequence
  chemically synthesized
ttatgttctgaaagaacacaaa

SEQ ID NO: 1398277 - DNA, 22 bp, Artificial Sequence
  chemically synthesized
tgttctgaaagaacacaaaagg

SEQ ID NO: 1398278 - DNA, 22 bp, Artificial Sequence
  chemically synthesized
aatgttattatagaccttttgt

SEQ ID NO: 1398279 - DNA, 22 bp, Artificial Sequence
  chemically synthesized
tgaaagaacacaaaaggtctat

SEQ ID NO: 1398280 - DNA, 22 bp, Artificial Sequence
  chemically synthesized
gttcaatgttattatagacctt

SEQ ID NO: 1398281 - DNA, 22 bp, Artificial Sequence
  chemically synthesized
aaagaacacaaaaggtctataa

SEQ ID NO: 1398282 - DNA, 22 bp, Artificial Sequence
  chemically synthesized
ataattggttcaatgttattat

SEQ ID NO: 1398283 - DNA, 22 bp, Artificial Sequence
  chemically synthesized
aataattggttcaatgttatta

SEQ ID NO: 1398284 - DNA, 22 bp, Artificial Sequence
  chemically synthesized
taataacattgaaccaattatt

SEQ ID NO: 1398285 - DNA, 22 bp, Artificial Sequence
  chemically synthesized
gaagaaaaatatacatttaata

SEQ ID NO: 1398286 - DNA, 22 bp, Artificial Sequence
  chemically synthesized
agaagaaaaatatacatttaat

SEQ ID NO: 1398287 - DNA, 22 bp, Artificial Sequence
  chemically synthesized
ttagaagaaaaatatacattta

SEQ ID NO: 1398288 - DNA, 22 bp, Artificial Sequence
  chemically synthesized
aaccaattattaaatgtatatt

SEQ ID NO: 1398289 - DNA, 22 bp, Artificial Sequence
  chemically synthesized
tcttagaagaaaaatatacatt

SEQ ID NO: 1398290 - DNA, 22 bp, Artificial Sequence
  chemically synthesized
ctcttagaagaaaaatatacat

SEQ ID NO: 1398291 - DNA, 22 bp, Artificial Sequence
  chemically synthesized
ttaaatgtatatttttcttcta

SEQ ID NO: 1398292 - DNA, 22 bp, Artificial Sequence
  chemically synthesized
aatgtatatttttcttctaaga

SEQ ID NO: 1398293 - DNA, 22 bp, Artificial Sequence
  chemically synthesized
aagaagcgaacttctcttagaa

SEQ ID NO: 1398294 - DNA, 22 bp, Artificial Sequence
  chemically synthesized
aaagaagcgaacttctcttaga

SEQ ID NO: 1398295 - DNA, 22 bp, Artificial Sequence
  chemically synthesized
taaagaagcgaacttctcttag

SEQ ID NO: 1398296 - DNA, 22 bp, Artificial Sequence
  chemically synthesized
ttcttctaagagaagttcgctt

SEQ ID NO: 1398297 - DNA, 22 bp, Artificial Sequence
  chemically synthesized
tcttctaagagaagttcgcttc

SEQ ID NO: 1398298 - DNA, 22 bp, Artificial Sequence
  chemically synthesized
cttctaagagaagttcgcttct

SEQ ID NO: 1398299 - DNA, 22 bp, Artificial Sequence
  chemically synthesized
ttctaagagaagttcgcttctt

SEQ ID NO: 1398300 - DNA, 22 bp, Artificial Sequence
  chemically synthesized
ctaagagaagttcgcttcttta

SEQ ID NO: 1398301 - DNA, 22 bp, Artificial Sequence
  chemically synthesized
taatccaaattttaaagaagcg

SEQ ID NO: 1398302 - DNA, 22 bp, Artificial Sequence
  chemically synthesized
taagagaagttcgcttctttaa

SEQ ID NO: 1398303 - DNA, 22 bp, Artificial Sequence
  chemically synthesized
agagaagttcgcttctttaaaa

SEQ ID NO: 1398304 - DNA, 22 bp, Artificial Sequence
  chemically synthesized
tattgtaatccaaattttaaag

SEQ ID NO: 1398305 - DNA, 22 bp, Artificial Sequence
  chemically synthesized
tatattgtaatccaaattttaa

SEQ ID NO: 1398306 - DNA, 22 bp, Artificial Sequence
  chemically synthesized
tctatattgtaatccaaatttt

SEQ ID NO: 1398307 - DNA, 22 bp, Artificial Sequence
  chemically synthesized
gcttctttaaaatttggattac

SEQ ID NO: 1398308 - DNA, 22 bp, Artificial Sequence
  chemically synthesized
ctttaaaatttggattacaata

SEQ ID NO: 1398309 - DNA, 22 bp, Artificial Sequence
  chemically synthesized
tttaaaatttggattacaatat

SEQ ID NO: 1398310 - DNA, 22 bp, Artificial Sequence
  chemically synthesized
ggtgatattctctatattgtaa

SEQ ID NO: 1398311 - DNA, 22 bp, Artificial Sequence
  chemically synthesized
taaaatttggattacaatatag

SEQ ID NO: 1398312 - DNA, 22 bp, Artificial Sequence
  chemically synthesized
aggtgatattctctatattgta

SEQ ID NO: 1398313 - DNA, 22 bp, Artificial Sequence
  chemically synthesized
aaaatttggattacaatataga

SEQ ID NO: 1398314 - DNA, 22 bp, Artificial Sequence
  chemically synthesized
aaatttggattacaatatagag

SEQ ID NO: 1398315 - DNA, 22 bp, Artificial Sequence
  chemically synthesized
ggattacaatatagagaatatc

SEQ ID NO: 1398316 - DNA, 22 bp, Artificial Sequence
  chemically synthesized
gattacaatatagagaatatca

SEQ ID NO: 1398317 - DNA, 22 bp, Artificial Sequence
  chemically synthesized
aaatgaataatttaggtgatat

SEQ ID NO: 1398318 - DNA, 22 bp, Artificial Sequence
  chemically synthesized
caatatagagaatatcacctaa

SEQ ID NO: 1398319 - DNA, 22 bp, Artificial Sequence
  chemically synthesized
attaaaatgaataatttaggtg

SEQ ID NO: 1398320 - DNA, 22 bp, Artificial Sequence
  chemically synthesized
aattaaaatgaataatttaggt

SEQ ID NO: 1398321 - DNA, 22 bp, Artificial Sequence
  chemically synthesized
aattattcattttaattaagtc

SEQ ID NO: 1398322 - DNA, 22 bp, Artificial Sequence
  chemically synthesized
ttcattttaattaagtcatttc

SEQ ID NO: 1398323 - DNA, 22 bp, Artificial Sequence
  chemically synthesized
agacaaaatcaggaaatgactt

SEQ ID NO: 1398324 - DNA, 22 bp, Artificial Sequence
  chemically synthesized
attttaattaagtcatttcctg

SEQ ID NO: 1398325 - DNA, 22 bp, Artificial Sequence
  chemically synthesized
ctaagacaaaatcaggaaatga

SEQ ID NO: 1398326 - DNA, 22 bp, Artificial Sequence
  chemically synthesized
taattaagtcatttcctgattt

SEQ ID NO: 1398327 - DNA, 22 bp, Artificial Sequence
  chemically synthesized
aattaagtcatttcctgatttt

SEQ ID NO: 1398328 - DNA, 22 bp, Artificial Sequence
  chemically synthesized
attaagtcatttcctgattttg

SEQ ID NO: 1398329 - DNA, 22 bp, Artificial Sequence
  chemically synthesized
tatctgctaagacaaaatcagg

SEQ ID NO: 1398330 - DNA, 22 bp, Artificial Sequence
  chemically synthesized
agtcatttcctgattttgtctt

SEQ ID NO: 1398331 - DNA, 22 bp, Artificial Sequence
  chemically synthesized
actgtatctgctaagacaaaat

SEQ ID NO: 1398332 - DNA, 22 bp, Artificial Sequence
  chemically synthesized
attgactgtatctgctaagaca

SEQ ID NO: 1398333 - DNA, 22 bp, Artificial Sequence
  chemically synthesized
aattgactgtatctgctaagac

SEQ ID NO: 1398334 - DNA, 22 bp, Artificial Sequence
  chemically synthesized
ttaattgactgtatctgctaag

SEQ ID NO: 1398335 - DNA, 22 bp, Artificial Sequence
  chemically synthesized
cctgattttgtcttagcagata

SEQ ID NO: 1398336 - DNA, 22 bp, Artificial Sequence
  chemically synthesized
cttaattgactgtatctgctaa

SEQ ID NO: 1398337 - DNA, 22 bp, Artificial Sequence
  chemically synthesized
ctgattttgtcttagcagatac

SEQ ID NO: 1398338 - DNA, 22 bp, Artificial Sequence
  chemically synthesized
attttgtcttagcagatacagt

SEQ ID NO: 1398339 - DNA, 22 bp, Artificial Sequence
  chemically synthesized
tgtcttagcagatacagtcaat

SEQ ID NO: 1398340 - DNA, 22 bp, Artificial Sequence
  chemically synthesized
gtcttagcagatacagtcaatt

SEQ ID NO: 1398341 - DNA, 22 bp, Artificial Sequence
  chemically synthesized
tcttagcagatacagtcaatta

SEQ ID NO: 1398342 - DNA, 22 bp, Artificial Sequence
  chemically synthesized
atatggataatttcttaattga

SEQ ID NO: 1398343 - DNA, 22 bp, Artificial Sequence
  chemically synthesized
agcagatacagtcaattaagaa

SEQ ID NO: 1398344 - DNA, 22 bp, Artificial Sequence
  chemically synthesized
gcagatacagtcaattaagaaa

SEQ ID NO: 1398345 - DNA, 22 bp, Artificial Sequence
  chemically synthesized
tgatgcaaggctaatatggata

SEQ ID NO: 1398346 - DNA, 22 bp, Artificial Sequence
  chemically synthesized
atgatgcaaggctaatatggat

SEQ ID NO: 1398347 - DNA, 22 bp, Artificial Sequence
  chemically synthesized
cttatgatgcaaggctaatatg

SEQ ID NO: 1398348 - DNA, 22 bp, Artificial Sequence
  chemically synthesized
acttatgatgcaaggctaatat

SEQ ID NO: 1398349 - DNA, 22 bp, Artificial Sequence
  chemically synthesized
agaaattatccatattagcctt

SEQ ID NO: 1398350 - DNA, 22 bp, Artificial Sequence
  chemically synthesized
gggcttacttatgatgcaaggc

SEQ ID NO: 1398351 - DNA, 22 bp, Artificial Sequence
  chemically synthesized
tccatattagccttgcatcata

SEQ ID NO: 1398352 - DNA, 22 bp, Artificial Sequence
  chemically synthesized
cagaattagggcttacttatga

SEQ ID NO: 1398353 - DNA, 22 bp, Artificial Sequence
  chemically synthesized
gcagaattagggcttacttatg

SEQ ID NO: 1398354 - DNA, 22 bp, Artificial Sequence
  chemically synthesized
tgcagaattagggcttacttat

SEQ ID NO: 1398355 - DNA, 22 bp, Artificial Sequence
  chemically synthesized
ttgcagaattagggcttactta

SEQ ID NO: 1398356 - DNA, 22 bp, Artificial Sequence
  chemically synthesized
gccttgcatcataagtaagccc

SEQ ID NO: 1398357 - DNA, 22 bp, Artificial Sequence
  chemically synthesized
aatttttgcagaattagggctt

SEQ ID NO: 1398358 - DNA, 22 bp, Artificial Sequence
  chemically synthesized
gcatcataagtaagccctaatt

SEQ ID NO: 1398359 - DNA, 22 bp, Artificial Sequence
  chemically synthesized
catcataagtaagccctaattc

SEQ ID NO: 1398360 - DNA, 22 bp, Artificial Sequence
  chemically synthesized
attctgcaaaaattgagtattg

SEQ ID NO: 1398361 - DNA, 22 bp, Artificial Sequence
  chemically synthesized
tgcaaaaattgagtattgtttc

SEQ ID NO: 1398362 - DNA, 22 bp, Artificial Sequence
  chemically synthesized
gaatcaggaaatgaaacaatac

SEQ ID NO: 1398363 - DNA, 22 bp, Artificial Sequence
  chemically synthesized
agaatcaggaaatgaaacaata

SEQ ID NO: 1398364 - DNA, 22 bp, Artificial Sequence
  chemically synthesized
caaaaattgagtattgtttcat

SEQ ID NO: 1398365 - DNA, 22 bp, Artificial Sequence
  chemically synthesized
caaatttagaatcaggaaatga

SEQ ID NO: 1398366 - DNA, 22 bp, Artificial Sequence
  chemically synthesized
gcaaatttagaatcaggaaatg

SEQ ID NO: 1398367 - DNA, 22 bp, Artificial Sequence
  chemically synthesized
agtattgtttcatttcctgatt

SEQ ID NO: 1398368 - DNA, 22 bp, Artificial Sequence
  chemically synthesized
tggcttgcaaatttagaatcag

SEQ ID NO: 1398369 - DNA, 22 bp, Artificial Sequence
  chemically synthesized
tgtggcttgcaaatttagaatc

SEQ ID NO: 1398370 - DNA, 22 bp, Artificial Sequence
  chemically synthesized
tttcatttcctgattctaaatt

SEQ ID NO: 1398371 - DNA, 22 bp, Artificial Sequence
  chemically synthesized
ctgtggcttgcaaatttagaat

SEQ ID NO: 1398372 - DNA, 22 bp, Artificial Sequence
  chemically synthesized
tctgtggcttgcaaatttagaa

SEQ ID NO: 1398373 - DNA, 22 bp, Artificial Sequence
  chemically synthesized
catttcctgattctaaatttgc

SEQ ID NO: 1398374 - DNA, 22 bp, Artificial Sequence
  chemically synthesized
atttcctgattctaaatttgca

SEQ ID NO: 1398375 - DNA, 22 bp, Artificial Sequence
  chemically synthesized
actttctgtggcttgcaaattt

SEQ ID NO: 1398376 - DNA, 22 bp, Artificial Sequence
  chemically synthesized
cctgattctaaatttgcaagcc

SEQ ID NO: 1398377 - DNA, 22 bp, Artificial Sequence
  chemically synthesized
ctgattctaaatttgcaagcca

SEQ ID NO: 1398378 - DNA, 22 bp, Artificial Sequence
  chemically synthesized
atctgactttctgtggcttgca

SEQ ID NO: 1398379 - DNA, 22 bp, Artificial Sequence
  chemically synthesized
gatctgactttctgtggcttgc

SEQ ID NO: 1398380 - DNA, 22 bp, Artificial Sequence
  chemically synthesized
attctaaatttgcaagccacag

SEQ ID NO: 1398381 - DNA, 22 bp, Artificial Sequence
  chemically synthesized
tgatctgactttctgtggcttg

SEQ ID NO: 1398382 - DNA, 22 bp, Artificial Sequence
  chemically synthesized
ttgatctgactttctgtggctt

SEQ ID NO: 1398383 - DNA, 22 bp, Artificial Sequence
  chemically synthesized
taaatttgcaagccacagaaag

SEQ ID NO: 1398384 - DNA, 22 bp, Artificial Sequence
  chemically synthesized
tttttgatctgactttctgtgg

SEQ ID NO: 1398385 - DNA, 22 bp, Artificial Sequence
  chemically synthesized
atttttgatctgactttctgtg

SEQ ID NO: 1398386 - DNA, 22 bp, Artificial Sequence
  chemically synthesized
aatttgcaagccacagaaagtc

SEQ ID NO: 1398387 - DNA, 22 bp, Artificial Sequence
  chemically synthesized
tatttttgatctgactttctgt

SEQ ID NO: 1398388 - DNA, 22 bp, Artificial Sequence
  chemically synthesized
gcaagccacagaaagtcagatc

SEQ ID NO: 1398389 - DNA, 22 bp, Artificial Sequence
  chemically synthesized
caagccacagaaagtcagatca

SEQ ID NO: 1398390 - DNA, 22 bp, Artificial Sequence
  chemically synthesized
gtaatctttatttttgatctga

SEQ ID NO: 1398391 - DNA, 22 bp, Artificial Sequence
  chemically synthesized
gactcgtaatctttatttttga

SEQ ID NO: 1398392 - DNA, 22 bp, Artificial Sequence
  chemically synthesized
acatcataagcctagactcgta

SEQ ID NO: 1398393 - DNA, 22 bp, Artificial Sequence
  chemically synthesized
aattaacatcataagcctagac

SEQ ID NO: 1398394 - DNA, 22 bp, Artificial Sequence
  chemically synthesized
cgagtctaggcttatgatgtta

SEQ ID NO: 1398395 - DNA, 22 bp, Artificial Sequence
  chemically synthesized
aaatatccactaaattaacatc

SEQ ID NO: 1398396 - DNA, 22 bp, Artificial Sequence
  chemically synthesized
ggcttatgatgttaatttagtg

SEQ ID NO: 1398397 - DNA, 22 bp, Artificial Sequence
  chemically synthesized
aattaaaatatccactaaatta

SEQ ID NO: 1398398 - DNA, 22 bp, Artificial Sequence
  chemically synthesized
aaattaaaatatccactaaatt

SEQ ID NO: 1398399 - DNA, 22 bp, Artificial Sequence
  chemically synthesized
taaattaaaatatccactaaat

SEQ ID NO: 1398400 - DNA, 22 bp, Artificial Sequence
  chemically synthesized
atgatgttaatttagtggatat

SEQ ID NO: 1398401 - DNA, 22 bp, Artificial Sequence
  chemically synthesized
tgatgttaatttagtggatatt

SEQ ID NO: 1398402 - DNA, 22 bp, Artificial Sequence
  chemically synthesized
agatctttaaattaaaatatcc

SEQ ID NO: 1398403 - DNA, 22 bp, Artificial Sequence
  chemically synthesized
gagatctttaaattaaaatatc

SEQ ID NO: 1398404 - DNA, 22 bp, Artificial Sequence
  chemically synthesized
atttagtggatattttaattta

SEQ ID NO: 1398405 - DNA, 22 bp, Artificial Sequence
  chemically synthesized
agtggatattttaatttaaaga

SEQ ID NO: 1398406 - DNA, 22 bp, Artificial Sequence
  chemically synthesized
gtggatattttaatttaaagat

SEQ ID NO: 1398407 - DNA, 22 bp, Artificial Sequence
  chemically synthesized
gggacatcttgagatctttaaa

SEQ ID NO: 1398408 - DNA, 22 bp, Artificial Sequence
  chemically synthesized
agggacatcttgagatctttaa

SEQ ID NO: 1398409 - DNA, 22 bp, Artificial Sequence
  chemically synthesized
tagggacatcttgagatcttta

SEQ ID NO: 1398410 - DNA, 22 bp, Artificial Sequence
  chemically synthesized
taatttaaagatctcaagatgt

SEQ ID NO: 1398411 - DNA, 22 bp, Artificial Sequence
  chemically synthesized
aatttaaagatctcaagatgtc

SEQ ID NO: 1398412 - DNA, 22 bp, Artificial Sequence
  chemically synthesized
gaatgttttagggacatcttga

SEQ ID NO: 1398413 - DNA, 22 bp, Artificial Sequence
  chemically synthesized
atttaaagatctcaagatgtcc

SEQ ID NO: 1398414 - DNA, 22 bp, Artificial Sequence
  chemically synthesized
agaatgttttagggacatcttg

SEQ ID NO: 1398415 - DNA, 22 bp, Artificial Sequence
  chemically synthesized
tagaatgttttagggacatctt

SEQ ID NO: 1398416 - DNA, 22 bp, Artificial Sequence
  chemically synthesized
aaagatctcaagatgtccctaa

SEQ ID NO: 1398417 - DNA, 22 bp, Artificial Sequence
  chemically synthesized
aagatctcaagatgtccctaaa

SEQ ID NO: 1398418 - DNA, 22 bp, Artificial Sequence
  chemically synthesized
taaaaattttagaatgttttag

SEQ ID NO: 1398419 - DNA, 22 bp, Artificial Sequence
  chemically synthesized
aagatgtccctaaaacattcta

SEQ ID NO: 1398420 - DNA, 22 bp, Artificial Sequence
  chemically synthesized
cagctataaaaattttagaatg

SEQ ID NO: 1398421 - DNA, 22 bp, Artificial Sequence
  chemically synthesized
aaacattctaaaatttttatag

SEQ ID NO: 1398422 - DNA, 22 bp, Artificial Sequence
  chemically synthesized
tcaacattacagctataaaaat

SEQ ID NO: 1398423 - DNA, 22 bp, Artificial Sequence
  chemically synthesized
taaaatttttatagctgtaatg

SEQ ID NO: 1398424 - DNA, 22 bp, Artificial Sequence
  chemically synthesized
aaatttttatagctgtaatgtt

SEQ ID NO: 1398425 - DNA, 22 bp, Artificial Sequence
  chemically synthesized
ttatagctgtaatgttgacaat

SEQ ID NO: 1398426 - DNA, 22 bp, Artificial Sequence
  chemically synthesized
tatagctgtaatgttgacaata

SEQ ID NO: 1398427 - DNA, 22 bp, Artificial Sequence
  chemically synthesized
atagctgtaatgttgacaatat

SEQ ID NO: 1398428 - DNA, 22 bp, Artificial Sequence
  chemically synthesized
tagctgtaatgttgacaatatc

SEQ ID NO: 1398429 - DNA, 22 bp, Artificial Sequence
  chemically synthesized
aaatcccatgccagatattgtc

SEQ ID NO: 1398430 - DNA, 22 bp, Artificial Sequence
  chemically synthesized
caaatcccatgccagatattgt

SEQ ID NO: 1398431 - DNA, 22 bp, Artificial Sequence
  chemically synthesized
ttcaaatcccatgccagatatt

SEQ ID NO: 1398432 - DNA, 22 bp, Artificial Sequence
  chemically synthesized
taatgttgacaatatctggcat

SEQ ID NO: 1398433 - DNA, 22 bp, Artificial Sequence
  chemically synthesized
atctcttcaaatcccatgccag

SEQ ID NO: 1398434 - DNA, 22 bp, Artificial Sequence
  chemically synthesized
acaatatctggcatgggatttg

SEQ ID NO: 1398435 - DNA, 22 bp, Artificial Sequence
  chemically synthesized
ccattaatctcttcaaatccca

SEQ ID NO: 1398436 - DNA, 22 bp, Artificial Sequence
  chemically synthesized
gccattaatctcttcaaatccc

SEQ ID NO: 1398437 - DNA, 22 bp, Artificial Sequence
  chemically synthesized
ttgccattaatctcttcaaatc

SEQ ID NO: 1398438 - DNA, 22 bp, Artificial Sequence
  chemically synthesized
cttgccattaatctcttcaaat

SEQ ID NO: 1398439 - DNA, 22 bp, Artificial Sequence
  chemically synthesized
ttcttgccattaatctcttcaa

SEQ ID NO: 1398440 - DNA, 22 bp, Artificial Sequence
  chemically synthesized
gcatgggatttgaagagattaa

SEQ ID NO: 1398441 - DNA, 22 bp, Artificial Sequence
  chemically synthesized
gaagagattaatggcaagaaga

SEQ ID NO: 1398442 - DNA, 22 bp, Artificial Sequence
  chemically synthesized
aagagattaatggcaagaagag

SEQ ID NO: 1398443 - DNA, 22 bp, Artificial Sequence
  chemically synthesized
atggcaagaagagggattttta

SEQ ID NO: 1398444 - DNA, 22 bp, Artificial Sequence
  chemically synthesized
gtgcatgaaacaacataaaaat

SEQ ID NO: 1398445 - DNA, 22 bp, Artificial Sequence
  chemically synthesized
tggtgcatgaaacaacataaaa

SEQ ID NO: 1398446 - DNA, 22 bp, Artificial Sequence
  chemically synthesized
tctggtgcatgaaacaacataa

SEQ ID NO: 1398447 - DNA, 22 bp, Artificial Sequence
  chemically synthesized
ctctggtgcatgaaacaacata

SEQ ID NO: 1398448 - DNA, 22 bp, Artificial Sequence
  chemically synthesized
tctctggtgcatgaaacaacat

SEQ ID NO: 1398449 - DNA, 22 bp, Artificial Sequence
  chemically synthesized
attttctctggtgcatgaaaca

SEQ ID NO: 1398450 - DNA, 22 bp, Artificial Sequence
  chemically synthesized
cattttctctggtgcatgaaac

SEQ ID NO: 1398451 - DNA, 22 bp, Artificial Sequence
  chemically synthesized
gcttcattttctctggtgcatg

SEQ ID NO: 1398452 - DNA, 22 bp, Artificial Sequence
  chemically synthesized
ttatgttgtttcatgcaccaga

SEQ ID NO: 1398453 - DNA, 22 bp, Artificial Sequence
  chemically synthesized
agcttcattttctctggtgcat

SEQ ID NO: 1398454 - DNA, 22 bp, Artificial Sequence
  chemically synthesized
tatgttgtttcatgcaccagag

SEQ ID NO: 1398455 - DNA, 22 bp, Artificial Sequence
  chemically synthesized
tagcttcattttctctggtgca

SEQ ID NO: 1398456 - DNA, 22 bp, Artificial Sequence
  chemically synthesized
atgttgtttcatgcaccagaga

SEQ ID NO: 1398457 - DNA, 22 bp, Artificial Sequence
  chemically synthesized
tgttgtttcatgcaccagagaa

SEQ ID NO: 1398458 - DNA, 22 bp, Artificial Sequence
  chemically synthesized
tttcatgcaccagagaaaatga

SEQ ID NO: 1398459 - DNA, 22 bp, Artificial Sequence
  chemically synthesized
catgcaccagagaaaatgaagc

SEQ ID NO: 1398460 - DNA, 22 bp, Artificial Sequence
  chemically synthesized
aaaatccctttagcttcatttt

SEQ ID NO: 1398461 - DNA, 22 bp, Artificial Sequence
  chemically synthesized
atgcaccagagaaaatgaagct

SEQ ID NO: 1398462 - DNA, 22 bp, Artificial Sequence
  chemically synthesized
caaaatccctttagcttcattt

SEQ ID NO: 1398463 - DNA, 22 bp, Artificial Sequence
  chemically synthesized
tcaaaatccctttagcttcatt

SEQ ID NO: 1398464 - DNA, 22 bp, Artificial Sequence
  chemically synthesized
ttttcaaaatccctttagcttc

SEQ ID NO: 1398465 - DNA, 22 bp, Artificial Sequence
  chemically synthesized
gttttcaaaatccctttagctt

SEQ ID NO: 1398466 - DNA, 22 bp, Artificial Sequence
  chemically synthesized
ttgttttcaaaatccctttagc

SEQ ID NO: 1398467 - DNA, 22 bp, Artificial Sequence
  chemically synthesized
attcttgttttcaaaatccctt

SEQ ID NO: 1398468 - DNA, 22 bp, Artificial Sequence
  chemically synthesized
gattcattcttgttttcaaaat

SEQ ID NO: 1398469 - DNA, 22 bp, Artificial Sequence
  chemically synthesized
tcgattcattcttgttttcaaa

SEQ ID NO: 1398470 - DNA, 22 bp, Artificial Sequence
  chemically synthesized
aagggattttgaaaacaagaat

SEQ ID NO: 1398471 - DNA, 22 bp, Artificial Sequence
  chemically synthesized
tgaaaacaagaatgaatcgaga

SEQ ID NO: 1398472 - DNA, 22 bp, Artificial Sequence
  chemically synthesized
gaacagcaaaactctcgattca

SEQ ID NO: 1398473 - DNA, 22 bp, Artificial Sequence
  chemically synthesized
gaaaacaagaatgaatcgagag

SEQ ID NO: 1398474 - DNA, 22 bp, Artificial Sequence
  chemically synthesized
agaacagcaaaactctcgattc

SEQ ID NO: 1398475 - DNA, 22 bp, Artificial Sequence
  chemically synthesized
aaaacaagaatgaatcgagagt

SEQ ID NO: 1398476 - DNA, 22 bp, Artificial Sequence
  chemically synthesized
cataacttagaacagcaaaact

SEQ ID NO: 1398477 - DNA, 22 bp, Artificial Sequence
  chemically synthesized
acataacttagaacagcaaaac

SEQ ID NO: 1398478 - DNA, 22 bp, Artificial Sequence
  chemically synthesized
tacataacttagaacagcaaaa

SEQ ID NO: 1398479 - DNA, 22 bp, Artificial Sequence
  chemically synthesized
tgctgttctaagttatgtaaag

SEQ ID NO: 1398480 - DNA, 22 bp, Artificial Sequence
  chemically synthesized
gctgttctaagttatgtaaaga

SEQ ID NO: 1398481 - DNA, 22 bp, Artificial Sequence
  chemically synthesized
ctgttctaagttatgtaaagat

SEQ ID NO: 1398482 - DNA, 22 bp, Artificial Sequence
  chemically synthesized
ttctaagttatgtaaagatatc

SEQ ID NO: 1398483 - DNA, 22 bp, Artificial Sequence
  chemically synthesized
taagttatgtaaagatatcatg

SEQ ID NO: 1398484 - DNA, 22 bp, Artificial Sequence
  chemically synthesized
ggatataaagtccatgatatct

SEQ ID NO: 1398485 - DNA, 22 bp, Artificial Sequence
  chemically synthesized
agttatgtaaagatatcatgga

SEQ ID NO: 1398486 - DNA, 22 bp, Artificial Sequence
  chemically synthesized
aactgggatataaagtccatga

SEQ ID NO: 1398487 - DNA, 22 bp, Artificial Sequence
  chemically synthesized
tgtaaagatatcatggacttta

SEQ ID NO: 1398488 - DNA, 22 bp, Artificial Sequence
  chemically synthesized
cattgaactgggatataaagtc

SEQ ID NO: 1398489 - DNA, 22 bp, Artificial Sequence
  chemically synthesized
tacattgaactgggatataaag

SEQ ID NO: 1398490 - DNA, 22 bp, Artificial Sequence
  chemically synthesized
tgaagttctacattgaactggg

SEQ ID NO: 1398491 - DNA, 22 bp, Artificial Sequence
  chemically synthesized
tatatcccagttcaatgtagaa

SEQ ID NO: 1398492 - DNA, 22 bp, Artificial Sequence
  chemically synthesized
atatcccagttcaatgtagaac

SEQ ID NO: 1398493 - DNA, 22 bp, Artificial Sequence
  chemically synthesized
taaaattatgaagttctacatt

SEQ ID NO: 1398494 - DNA, 22 bp, Artificial Sequence
  chemically synthesized
tatcccagttcaatgtagaact

SEQ ID NO: 1398495 - DNA, 22 bp, Artificial Sequence
  chemically synthesized
ataaaattatgaagttctacat

SEQ ID NO: 1398496 - DNA, 22 bp, Artificial Sequence
  chemically synthesized
aatgtagaacttcataatttta

SEQ ID NO: 1398497 - DNA, 22 bp, Artificial Sequence
  chemically synthesized
tgtatatatgtatatttataaa

SEQ ID NO: 1398498 - DNA, 22 bp, Artificial Sequence
  chemically synthesized
atgtatatatgtatatttataa

SEQ ID NO: 1398499 - DNA, 22 bp, Artificial Sequence
  chemically synthesized
cataattttataaatatacata

SEQ ID NO: 1398500 - DNA, 22 bp, Artificial Sequence
  chemically synthesized
ataattttataaatatacatat

SEQ ID NO: 1398501 - DNA, 22 bp, Artificial Sequence
  chemically synthesized
gatatttatgtatatatgtata

SEQ ID NO: 1398502 - DNA, 22 bp, Artificial Sequence
  chemically synthesized
tataaatatacatatatacata

SEQ ID NO: 1398503 - DNA, 22 bp, Artificial Sequence
  chemically synthesized
ataaatatacatatatacataa

SEQ ID NO: 1398504 - DNA, 22 bp, Artificial Sequence
  chemically synthesized
taaatatacatatatacataaa

SEQ ID NO: 1398505 - DNA, 22 bp, Artificial Sequence
  chemically synthesized
agtatatgtatatgtgttagat

SEQ ID NO: 1398506 - DNA, 22 bp, Artificial Sequence
  chemically synthesized
tattaagtatatgtatatgtgt

SEQ ID NO: 1398507 - DNA, 22 bp, Artificial Sequence
  chemically synthesized
acacatatacatatacttaata

SEQ ID NO: 1398508 - DNA, 22 bp, Artificial Sequence
  chemically synthesized
aatataattcatgcatatatat

SEQ ID NO: 1398509 - DNA, 22 bp, Artificial Sequence
  chemically synthesized
atataattcatgcatatatatg

SEQ ID NO: 1398510 - DNA, 22 bp, Artificial Sequence
  chemically synthesized
atgcatatatatgcatatatac

SEQ ID NO: 1398511 - DNA, 22 bp, Artificial Sequence
  chemically synthesized
aagtaggtatatacagtatgaa

SEQ ID NO: 1398512 - DNA, 22 bp, Artificial Sequence
  chemically synthesized
tatattaaagtaggtatataca

SEQ ID NO: 1398513 - DNA, 22 bp, Artificial Sequence
  chemically synthesized
catactgtatatacctacttta

SEQ ID NO: 1398514 - DNA, 22 bp, Artificial Sequence
  chemically synthesized
atactgtatatacctactttaa

SEQ ID NO: 1398515 - DNA, 22 bp, Artificial Sequence
  chemically synthesized
tatatacctactttaatatata

SEQ ID NO: 1398516 - DNA, 22 bp, Artificial Sequence
  chemically synthesized
ctttaatatatagatacacata

SEQ ID NO: 1398517 - DNA, 22 bp, Artificial Sequence
  chemically synthesized
taatatatagatacacatatgt

SEQ ID NO: 1398518 - DNA, 22 bp, Artificial Sequence
  chemically synthesized
aatatatagatacacatatgta

SEQ ID NO: 1398519 - DNA, 22 bp, Artificial Sequence
  chemically synthesized
atatatagatacacatatgtat

SEQ ID NO: 1398520 - DNA, 22 bp, Artificial Sequence
  chemically synthesized
agtgtgtgtatgtgtgtatgca

SEQ ID NO: 1398521 - DNA, 22 bp, Artificial Sequence
  chemically synthesized
tagttaagtgtgtgtatgtgtg

SEQ ID NO: 1398522 - DNA, 22 bp, Artificial Sequence
  chemically synthesized
agcatatgtatatatatattat

SEQ ID NO: 1398523 - DNA, 22 bp, Artificial Sequence
  chemically synthesized
tattaagcatatgtatatatat

SEQ ID NO: 1398524 - DNA, 22 bp, Artificial Sequence
  chemically synthesized
aactataatatatatatacata

SEQ ID NO: 1398525 - DNA, 22 bp, Artificial Sequence
  chemically synthesized
actataatatatatatacatat

SEQ ID NO: 1398526 - DNA, 22 bp, Artificial Sequence
  chemically synthesized
taatatatatatacatatgctt

SEQ ID NO: 1398527 - DNA, 22 bp, Artificial Sequence
  chemically synthesized
aatataattcatgcatatatat

SEQ ID NO: 1398528 - DNA, 22 bp, Artificial Sequence
  chemically synthesized
atataattcatgcatatatatg

SEQ ID NO: 1398529 - DNA, 22 bp, Artificial Sequence
  chemically synthesized
atgcatatatatgcatatatac

SEQ ID NO: 1398530 - DNA, 22 bp, Artificial Sequence
  chemically synthesized
aagtatgtatatgcaatatgaa

SEQ ID NO: 1398531 - DNA, 22 bp, Artificial Sequence
  chemically synthesized
tatattaaagtatgtatatgca

SEQ ID NO: 1398532 - DNA, 22 bp, Artificial Sequence
  chemically synthesized
catattgcatatacatacttta

SEQ ID NO: 1398533 - DNA, 22 bp, Artificial Sequence
  chemically synthesized
atattgcatatacatactttaa

SEQ ID NO: 1398534 - DNA, 22 bp, Artificial Sequence
  chemically synthesized
catatacatactttaatatata

SEQ ID NO: 1398535 - DNA, 22 bp, Artificial Sequence
  chemically synthesized
taatatatagatacacacatat

SEQ ID NO: 1398536 - DNA, 22 bp, Artificial Sequence
  chemically synthesized
aatatatagatacacacatatg

SEQ ID NO: 1398537 - DNA, 22 bp, Artificial Sequence
  chemically synthesized
tgtgtatgcatacatatgtgtg

SEQ ID NO: 1398538 - DNA, 22 bp, Artificial Sequence
  chemically synthesized
atatatagatacacacatatgt

SEQ ID NO: 1398539 - DNA, 22 bp, Artificial Sequence
  chemically synthesized
tctgtgtgtatgcatacatatg

SEQ ID NO: 1398540 - DNA, 22 bp, Artificial Sequence
  chemically synthesized
tagataagtgtctgtctgtgtg

SEQ ID NO: 1398541 - DNA, 22 bp, Artificial Sequence
  chemically synthesized
atctataatatatatacacctg

SEQ ID NO: 1398542 - DNA, 22 bp, Artificial Sequence
  chemically synthesized
tctataatatatatacacctgt

SEQ ID NO: 1398543 - DNA, 22 bp, Artificial Sequence
  chemically synthesized
tggtaagaacagacaggtgtat

SEQ ID NO: 1398544 - DNA, 22 bp, Artificial Sequence
  chemically synthesized
taatatatatacacctgtctgt

SEQ ID NO: 1398545 - DNA, 22 bp, Artificial Sequence
  chemically synthesized
ggaatatatctgtggtaagaac

SEQ ID NO: 1398546 - DNA, 22 bp, Artificial Sequence
  chemically synthesized
ctaggaatatatctgtggtaag

SEQ ID NO: 1398547 - DNA, 22 bp, Artificial Sequence
  chemically synthesized
tctgttcttaccacagatatat

SEQ ID NO: 1398548 - DNA, 22 bp, Artificial Sequence
  chemically synthesized
ccaccctcctaggaatatatct

SEQ ID NO: 1398549 - DNA, 22 bp, Artificial Sequence
  chemically synthesized
ttcttaccacagatatattcct

SEQ ID NO: 1398550 - DNA, 22 bp, Artificial Sequence
  chemically synthesized
actaccaccctcctaggaatat

SEQ ID NO: 1398551 - DNA, 22 bp, Artificial Sequence
  chemically synthesized
ttaccacagatatattcctagg

SEQ ID NO: 1398552 - DNA, 22 bp, Artificial Sequence
  chemically synthesized
aactaccaccctcctaggaata

SEQ ID NO: 1398553 - DNA, 22 bp, Artificial Sequence
  chemically synthesized
accacagatatattcctaggag

SEQ ID NO: 1398554 - DNA, 22 bp, Artificial Sequence
  chemically synthesized
ccacagatatattcctaggagg

SEQ ID NO: 1398555 - DNA, 22 bp, Artificial Sequence
  chemically synthesized
gtaccttaactaccaccctcct

SEQ ID NO: 1398556 - DNA, 22 bp, Artificial Sequence
  chemically synthesized
agtaccttaactaccaccctcc

SEQ ID NO: 1398557 - DNA, 22 bp, Artificial Sequence
  chemically synthesized
tagtaccttaactaccaccctc

SEQ ID NO: 1398558 - DNA, 22 bp, Artificial Sequence
  chemically synthesized
ctttagtaccttaactaccacc

SEQ ID NO: 1398559 - DNA, 22 bp, Artificial Sequence
  chemically synthesized
ctaggagggtggtagttaaggt

SEQ ID NO: 1398560 - DNA, 22 bp, Artificial Sequence
  chemically synthesized
ggagggtggtagttaaggtact

SEQ ID NO: 1398561 - DNA, 22 bp, Artificial Sequence
  chemically synthesized
catgaccctactttagtacctt

SEQ ID NO: 1398562 - DNA, 22 bp, Artificial Sequence
  chemically synthesized
acatgaccctactttagtacct

SEQ ID NO: 1398563 - DNA, 22 bp, Artificial Sequence
  chemically synthesized
tacatgaccctactttagtacc

SEQ ID NO: 1398564 - DNA, 22 bp, Artificial Sequence
  chemically synthesized
attttacatgaccctactttag

SEQ ID NO: 1398565 - DNA, 22 bp, Artificial Sequence
  chemically synthesized
aggtactaaagtagggtcatgt

SEQ ID NO: 1398566 - DNA, 22 bp, Artificial Sequence
  chemically synthesized
aaatctcattttacatgaccct

SEQ ID NO: 1398567 - DNA, 22 bp, Artificial Sequence
  chemically synthesized
ctaaaatctcattttacatgac

SEQ ID NO: 1398568 - DNA, 22 bp, Artificial Sequence
  chemically synthesized
actaaaatctcattttacatga

SEQ ID NO: 1398569 - DNA, 22 bp, Artificial Sequence
  chemically synthesized
aagtagggtcatgtaaaatgag

SEQ ID NO: 1398570 - DNA, 22 bp, Artificial Sequence
  chemically synthesized
aatttactaaaatctcatttta

SEQ ID NO: 1398571 - DNA, 22 bp, Artificial Sequence
  chemically synthesized
tgaatttactaaaatctcattt

SEQ ID NO: 1398572 - DNA, 22 bp, Artificial Sequence
  chemically synthesized
ctgaatttactaaaatctcatt

SEQ ID NO: 1398573 - DNA, 22 bp, Artificial Sequence
  chemically synthesized
tctgaatttactaaaatctcat

SEQ ID NO: 1398574 - DNA, 22 bp, Artificial Sequence
  chemically synthesized
caaagtctttctgaatttacta

SEQ ID NO: 1398575 - DNA, 22 bp, Artificial Sequence
  chemically synthesized
ccaaagtctttctgaatttact

SEQ ID NO: 1398576 - DNA, 22 bp, Artificial Sequence
  chemically synthesized
tttccaaagtctttctgaattt

SEQ ID NO: 1398577 - DNA, 22 bp, Artificial Sequence
  chemically synthesized
tagtaaattcagaaagactttg

SEQ ID NO: 1398578 - DNA, 22 bp, Artificial Sequence
  chemically synthesized
agtaaattcagaaagactttgg

SEQ ID NO: 1398579 - DNA, 22 bp, Artificial Sequence
  chemically synthesized
gtaaattcagaaagactttgga

SEQ ID NO: 1398580 - DNA, 22 bp, Artificial Sequence
  chemically synthesized
agaaagactttggaaataatct

SEQ ID NO: 1398581 - DNA, 22 bp, Artificial Sequence
  chemically synthesized
tgtaaataaggtagattatttc

SEQ ID NO: 1398582 - DNA, 22 bp, Artificial Sequence
  chemically synthesized
atgtaaataaggtagattattt

SEQ ID NO: 1398583 - DNA, 22 bp, Artificial Sequence
  chemically synthesized
tatgtaaataaggtagattatt

SEQ ID NO: 1398584 - DNA, 22 bp, Artificial Sequence
  chemically synthesized
ttatgtaaataaggtagattat

SEQ ID NO: 1398585 - DNA, 22 bp, Artificial Sequence
  chemically synthesized
tttatgtaaataaggtagatta

SEQ ID NO: 1398586 - DNA, 22 bp, Artificial Sequence
  chemically synthesized
ttttttatgtaaataaggtaga

SEQ ID NO: 1398587 - DNA, 22 bp, Artificial Sequence
  chemically synthesized
tggaaataatctaccttattta

SEQ ID NO: 1398588 - DNA, 22 bp, Artificial Sequence
  chemically synthesized
ggaaataatctaccttatttac

SEQ ID NO: 1398589 - DNA, 22 bp, Artificial Sequence
  chemically synthesized
gaaataatctaccttatttaca

SEQ ID NO: 1398590 - DNA, 22 bp, Artificial Sequence
  chemically synthesized
accatattattttttatgtaaa

SEQ ID NO: 1398591 - DNA, 22 bp, Artificial Sequence
  chemically synthesized
caccatattattttttatgtaa

SEQ ID NO: 1398592 - DNA, 22 bp, Artificial Sequence
  chemically synthesized
tttcaccatattattttttatg

SEQ ID NO: 1398593 - DNA, 22 bp, Artificial Sequence
  chemically synthesized
ccttatttacataaaaaataat

SEQ ID NO: 1398594 - DNA, 22 bp, Artificial Sequence
  chemically synthesized
ctatttcaccatattatttttt

SEQ ID NO: 1398595 - DNA, 22 bp, Artificial Sequence
  chemically synthesized
gctatttcaccatattattttt

SEQ ID NO: 1398596 - DNA, 22 bp, Artificial Sequence
  chemically synthesized
atttacataaaaaataatatgg

SEQ ID NO: 1398597 - DNA, 22 bp, Artificial Sequence
  chemically synthesized
tttgctatttcaccatattatt

SEQ ID NO: 1398598 - DNA, 22 bp, Artificial Sequence
  chemically synthesized
tttacataaaaaataatatggt

SEQ ID NO: 1398599 - DNA, 22 bp, Artificial Sequence
  chemically synthesized
gtttgctatttcaccatattat

SEQ ID NO: 1398600 - DNA, 22 bp, Artificial Sequence
  chemically synthesized
tgtttgctatttcaccatatta

SEQ ID NO: 1398601 - DNA, 22 bp, Artificial Sequence
  chemically synthesized
acataaaaaataatatggtgaa

SEQ ID NO: 1398602 - DNA, 22 bp, Artificial Sequence
  chemically synthesized
cataaaaaataatatggtgaaa

SEQ ID NO: 1398603 - DNA, 22 bp, Artificial Sequence
  chemically synthesized
acagacatacgatcattttgtt

SEQ ID NO: 1398604 - DNA, 22 bp, Artificial Sequence
  chemically synthesized
aacagacatacgatcattttgt

SEQ ID NO: 1398605 - DNA, 22 bp, Artificial Sequence
  chemically synthesized
gtttaacagacatacgatcatt

SEQ ID NO: 1398606 - DNA, 22 bp, Artificial Sequence
  chemically synthesized
ggtttaacagacatacgatcat

SEQ ID NO: 1398607 - DNA, 22 bp, Artificial Sequence
  chemically synthesized
gtaagtaatgtcaatacaatat

SEQ ID NO: 1398608 - DNA, 22 bp, Artificial Sequence
  chemically synthesized
ttaaaccaaatattgtattgac

SEQ ID NO: 1398609 - DNA, 22 bp, Artificial Sequence
  chemically synthesized
aaccaaatattgtattgacatt

SEQ ID NO: 1398610 - DNA, 22 bp, Artificial Sequence
  chemically synthesized
gtattcgtaagtaatgtcaata

SEQ ID NO: 1398611 - DNA, 22 bp, Artificial Sequence
  chemically synthesized
agtattcgtaagtaatgtcaat

SEQ ID NO: 1398612 - DNA, 22 bp, Artificial Sequence
  chemically synthesized
tagtattcgtaagtaatgtcaa

SEQ ID NO: 1398613 - DNA, 22 bp, Artificial Sequence
  chemically synthesized
agactttagtattcgtaagtaa

SEQ ID NO: 1398614 - DNA, 22 bp, Artificial Sequence
  chemically synthesized
tattgacattacttacgaatac

SEQ ID NO: 1398615 - DNA, 22 bp, Artificial Sequence
  chemically synthesized
acattacttacgaatactaaag

SEQ ID NO: 1398616 - DNA, 22 bp, Artificial Sequence
  chemically synthesized
cttacgaatactaaagtctgaa

SEQ ID NO: 1398617 - DNA, 22 bp, Artificial Sequence
  chemically synthesized
acgaatactaaagtctgaattt

SEQ ID NO: 1398618 - DNA, 22 bp, Artificial Sequence
  chemically synthesized
cgaatactaaagtctgaatttt

SEQ ID NO: 1398619 - DNA, 22 bp, Artificial Sequence
  chemically synthesized
aagtctgaatttttttcttgtt

SEQ ID NO: 1398620 - DNA, 22 bp, Artificial Sequence
  chemically synthesized
tgaacacagcagcaaaaaacaa

SEQ ID NO: 1398621 - DNA, 22 bp, Artificial Sequence
  chemically synthesized
aatttttttcttgttttttgct

SEQ ID NO: 1398622 - DNA, 22 bp, Artificial Sequence
  chemically synthesized
ttttcttgttttttgctgctgt

SEQ ID NO: 1398623 - DNA, 22 bp, Artificial Sequence
  chemically synthesized
tttcttgttttttgctgctgtg

SEQ ID NO: 1398624 - DNA, 22 bp, Artificial Sequence
  chemically synthesized
ttcttgttttttgctgctgtgt

SEQ ID NO: 1398625 - DNA, 22 bp, Artificial Sequence
  chemically synthesized
tcttgttttttgctgctgtgtt

SEQ ID NO: 1398626 - DNA, 22 bp, Artificial Sequence
  chemically synthesized
cttgttttttgctgctgtgttc

SEQ ID NO: 1398627 - DNA, 22 bp, Artificial Sequence
  chemically synthesized
ttgttttttgctgctgtgttca

SEQ ID NO: 1398628 - DNA, 22 bp, Artificial Sequence
  chemically synthesized
gttttttgctgctgtgttcata

SEQ ID NO: 1398629 - DNA, 22 bp, Artificial Sequence
  chemically synthesized
ttttttgctgctgtgttcataa

SEQ ID NO: 1398630 - DNA, 22 bp, Artificial Sequence
  chemically synthesized
tttgctgctgtgttcataatgt

SEQ ID NO: 1398631 - DNA, 22 bp, Artificial Sequence
  chemically synthesized
ttgctgctgtgttcataatgtt

SEQ ID NO: 1398632 - DNA, 22 bp, Artificial Sequence
  chemically synthesized
tgctgctgtgttcataatgtta

SEQ ID NO: 1398633 - DNA, 22 bp, Artificial Sequence
  chemically synthesized
gctgctgtgttcataatgttat

SEQ ID NO: 1398634 - DNA, 22 bp, Artificial Sequence
  chemically synthesized
ctgctgtgttcataatgttatg

SEQ ID NO: 1398635 - DNA, 22 bp, Artificial Sequence
  chemically synthesized
gatcatcgtgtatcataacatt

SEQ ID NO: 1398636 - DNA, 22 bp, Artificial Sequence
  chemically synthesized
ctgtgttcataatgttatgata

SEQ ID NO: 1398637 - DNA, 22 bp, Artificial Sequence
  chemically synthesized
tgttcataatgttatgatacac

SEQ ID NO: 1398638 - DNA, 22 bp, Artificial Sequence
  chemically synthesized
tactagatcatcgtgtatcata

SEQ ID NO: 1398639 - DNA, 22 bp, Artificial Sequence
  chemically synthesized
gtactagatcatcgtgtatcat

SEQ ID NO: 1398640 - DNA, 22 bp, Artificial Sequence
  chemically synthesized
cttgtactagatcatcgtgtat

SEQ ID NO: 1398641 - DNA, 22 bp, Artificial Sequence
  chemically synthesized
ataatgttatgatacacgatga

SEQ ID NO: 1398642 - DNA, 22 bp, Artificial Sequence
  chemically synthesized
aagaaattccttgtactagatc

SEQ ID NO: 1398643 - DNA, 22 bp, Artificial Sequence
  chemically synthesized
tgatacacgatgatctagtaca

SEQ ID NO: 1398644 - DNA, 22 bp, Artificial Sequence
  chemically synthesized
caagaaattccttgtactagat

SEQ ID NO: 1398645 - DNA, 22 bp, Artificial Sequence
  chemically synthesized
tcaagaaattccttgtactaga

SEQ ID NO: 1398646 - DNA, 22 bp, Artificial Sequence
  chemically synthesized
aaatatgctttcaagaaattcc

SEQ ID NO: 1398647 - DNA, 22 bp, Artificial Sequence
  chemically synthesized
gaaatatgctttcaagaaattc

SEQ ID NO: 1398648 - DNA, 22 bp, Artificial Sequence
  chemically synthesized
ttgaaatatgctttcaagaaat

SEQ ID NO: 1398649 - DNA, 22 bp, Artificial Sequence
  chemically synthesized
cttgaaatatgctttcaagaaa

SEQ ID NO: 1398650 - DNA, 22 bp, Artificial Sequence
  chemically synthesized
tcttgaaatatgctttcaagaa

SEQ ID NO: 1398651 - DNA, 22 bp, Artificial Sequence
  chemically synthesized
gtacaaggaatttcttgaaagc

SEQ ID NO: 1398652 - DNA, 22 bp, Artificial Sequence
  chemically synthesized
ttttcttgaaatatgctttcaa

SEQ ID NO: 1398653 - DNA, 22 bp, Artificial Sequence
  chemically synthesized
tattttcttgaaatatgctttc

SEQ ID NO: 1398654 - DNA, 22 bp, Artificial Sequence
  chemically synthesized
cctctattttcttgaaatatgc

SEQ ID NO: 1398655 - DNA, 22 bp, Artificial Sequence
  chemically synthesized
acctctattttcttgaaatatg

SEQ ID NO: 1398656 - DNA, 22 bp, Artificial Sequence
  chemically synthesized
tacctctattttcttgaaatat

SEQ ID NO: 1398657 - DNA, 22 bp, Artificial Sequence
  chemically synthesized
cttgaaagcatatttcaagaaa

SEQ ID NO: 1398658 - DNA, 22 bp, Artificial Sequence
  chemically synthesized
ttgaaagcatatttcaagaaaa

SEQ ID NO: 1398659 - DNA, 22 bp, Artificial Sequence
  chemically synthesized
gaaagcatatttcaagaaaata

SEQ ID NO: 1398660 - DNA, 22 bp, Artificial Sequence
  chemically synthesized
aaagcatatttcaagaaaatag

SEQ ID NO: 1398661 - DNA, 22 bp, Artificial Sequence
  chemically synthesized
ataaaatagagccctttacctc

SEQ ID NO: 1398662 - DNA, 22 bp, Artificial Sequence
  chemically synthesized
caagaaaatagaggtaaagggc

SEQ ID NO: 1398663 - DNA, 22 bp, Artificial Sequence
  chemically synthesized
aagaaaatagaggtaaagggct

SEQ ID NO: 1398664 - DNA, 22 bp, Artificial Sequence
  chemically synthesized
atggcattgataaaatagagcc

SEQ ID NO: 1398665 - DNA, 22 bp, Artificial Sequence
  chemically synthesized
tattttatcaatgccattagtt

SEQ ID NO: 1398666 - DNA, 22 bp, Artificial Sequence
  chemically synthesized
ttttatcaatgccattagttac

SEQ ID NO: 1398667 - DNA, 22 bp, Artificial Sequence
  chemically synthesized
tatcaatgccattagttactgg

SEQ ID NO: 1398668 - DNA, 22 bp, Artificial Sequence
  chemically synthesized
atcaatgccattagttactggc

SEQ ID NO: 1398669 - DNA, 22 bp, Artificial Sequence
  chemically synthesized
tcaatgccattagttactggcc

SEQ ID NO: 1398670 - DNA, 22 bp, Artificial Sequence
  chemically synthesized
cgcataagagcaggtggccagt

SEQ ID NO: 1398671 - DNA, 22 bp, Artificial Sequence
  chemically synthesized
gttactggccacctgctcttat

SEQ ID NO: 1398672 - DNA, 22 bp, Artificial Sequence
  chemically synthesized
aacagaaccctacgcataagag

SEQ ID NO: 1398673 - DNA, 22 bp, Artificial Sequence
  chemically synthesized
ctggccacctgctcttatgcgt

SEQ ID NO: 1398674 - DNA, 22 bp, Artificial Sequence
  chemically synthesized
gccacctgctcttatgcgtagg

SEQ ID NO: 1398675 - DNA, 22 bp, Artificial Sequence
  chemically synthesized
tatcctaaacagaaccctacgc

SEQ ID NO: 1398676 - DNA, 22 bp, Artificial Sequence
  chemically synthesized
ctcttatgcgtagggttctgtt

SEQ ID NO: 1398677 - DNA, 22 bp, Artificial Sequence
  chemically synthesized
ttatgcgtagggttctgtttag

SEQ ID NO: 1398678 - DNA, 22 bp, Artificial Sequence
  chemically synthesized
tatgtctatatcctaaacagaa

SEQ ID NO: 1398679 - DNA, 22 bp, Artificial Sequence
  chemically synthesized
atatgtctatatcctaaacaga

SEQ ID NO: 1398680 - DNA, 22 bp, Artificial Sequence
  chemically synthesized
atgcgtagggttctgtttagga

SEQ ID NO: 1398681 - DNA, 22 bp, Artificial Sequence
  chemically synthesized
tgcgtagggttctgtttaggat

SEQ ID NO: 1398682 - DNA, 22 bp, Artificial Sequence
  chemically synthesized
tttatatgtctatatcctaaac

SEQ ID NO: 1398683 - DNA, 22 bp, Artificial Sequence
  chemically synthesized
ttatttatatgtctatatccta

SEQ ID NO: 1398684 - DNA, 22 bp, Artificial Sequence
  chemically synthesized
gttatttatatgtctatatcct

SEQ ID NO: 1398685 - DNA, 22 bp, Artificial Sequence
  chemically synthesized
tgttatttatatgtctatatcc

SEQ ID NO: 1398686 - DNA, 22 bp, Artificial Sequence
  chemically synthesized
ttgttatttatatgtctatatc

SEQ ID NO: 1398687 - DNA, 22 bp, Artificial Sequence
  chemically synthesized
tgtttaggatatagacatataa

SEQ ID NO: 1398688 - DNA, 22 bp, Artificial Sequence
  chemically synthesized
tatttttgttatttatatgtct

SEQ ID NO: 1398689 - DNA, 22 bp, Artificial Sequence
  chemically synthesized
atatttttgttatttatatgtc

SEQ ID NO: 1398690 - DNA, 22 bp, Artificial Sequence
  chemically synthesized
tttaggatatagacatataaat

SEQ ID NO: 1398691 - DNA, 22 bp, Artificial Sequence
  chemically synthesized
aggatatagacatataaataac

SEQ ID NO: 1398692 - DNA, 22 bp, Artificial Sequence
  chemically synthesized
ggatatagacatataaataaca

SEQ ID NO: 1398693 - DNA, 22 bp, Artificial Sequence
  chemically synthesized
tgtatttatatttttgttattt

SEQ ID NO: 1398694 - DNA, 22 bp, Artificial Sequence
  chemically synthesized
atgtatttatatttttgttatt

SEQ ID NO: 1398695 - DNA, 22 bp, Artificial Sequence
  chemically synthesized
tatgtatttatatttttgttat

SEQ ID NO: 1398696 - DNA, 22 bp, Artificial Sequence
  chemically synthesized
ttatgtatttatatttttgtta

SEQ ID NO: 1398697 - DNA, 22 bp, Artificial Sequence
  chemically synthesized
tttatgtatttatatttttgtt

SEQ ID NO: 1398698 - DNA, 22 bp, Artificial Sequence
  chemically synthesized
ttttatgtatttatatttttgt

SEQ ID NO: 1398699 - DNA, 22 bp, Artificial Sequence
  chemically synthesized
gcaaatggcttttttatgtatt

SEQ ID NO: 1398700 - DNA, 22 bp, Artificial Sequence
  chemically synthesized
ggcaaatggcttttttatgtat

SEQ ID NO: 1398701 - DNA, 22 bp, Artificial Sequence
  chemically synthesized
gcacttggcaaatggctttttt

SEQ ID NO: 1398702 - DNA, 22 bp, Artificial Sequence
  chemically synthesized
ggcacttggcaaatggcttttt

SEQ ID NO: 1398703 - DNA, 22 bp, Artificial Sequence
  chemically synthesized
caccatttggcacttggcaaat

SEQ ID NO: 1398704 - DNA, 22 bp, Artificial Sequence
  chemically synthesized
cctgcaccatttggcacttggc

SEQ ID NO: 1398705 - DNA, 22 bp, Artificial Sequence
  chemically synthesized
caactccctgcaccatttggca

SEQ ID NO: 1398706 - DNA, 22 bp, Artificial Sequence
  chemically synthesized
ccaactccctgcaccatttggc

SEQ ID NO: 1398707 - DNA, 22 bp, Artificial Sequence
  chemically synthesized
gccaagtgccaaatggtgcagg

SEQ ID NO: 1398708 - DNA, 22 bp, Artificial Sequence
  chemically synthesized
ccaagtgccaaatggtgcaggg

SEQ ID NO: 1398709 - DNA, 22 bp, Artificial Sequence
  chemically synthesized
cgacttccaactccctgcacca

SEQ ID NO: 1398710 - DNA, 22 bp, Artificial Sequence
  chemically synthesized
gccatggtaatgataaaatctc

SEQ ID NO: 1398711 - DNA, 22 bp, Artificial Sequence
  chemically synthesized
gaagtcggagattttatcatta

SEQ ID NO: 1398712 - DNA, 22 bp, Artificial Sequence
  chemically synthesized
tgctagccatggtaatgataaa

SEQ ID NO: 1398713 - DNA, 22 bp, Artificial Sequence
  chemically synthesized
ttatgctagccatggtaatgat

SEQ ID NO: 1398714 - DNA, 22 bp, Artificial Sequence
  chemically synthesized
attatgctagccatggtaatga

SEQ ID NO: 1398715 - DNA, 22 bp, Artificial Sequence
  chemically synthesized
tattatgctagccatggtaatg

SEQ ID NO: 1398716 - DNA, 22 bp, Artificial Sequence
  chemically synthesized
ttattatgctagccatggtaat

SEQ ID NO: 1398717 - DNA, 22 bp, Artificial Sequence
  chemically synthesized
tttttattatgctagccatggt

SEQ ID NO: 1398718 - DNA, 22 bp, Artificial Sequence
  chemically synthesized
tgtttttattatgctagccatg

SEQ ID NO: 1398719 - DNA, 22 bp, Artificial Sequence
  chemically synthesized
ctgtttttattatgctagccat

SEQ ID NO: 1398720 - DNA, 22 bp, Artificial Sequence
  chemically synthesized
tctgtttttattatgctagcca

SEQ ID NO: 1398721 - DNA, 22 bp, Artificial Sequence
  chemically synthesized
tatcattaccatggctagcata

SEQ ID NO: 1398722 - DNA, 22 bp, Artificial Sequence
  chemically synthesized
atcattaccatggctagcataa

SEQ ID NO: 1398723 - DNA, 22 bp, Artificial Sequence
  chemically synthesized
tttctgtttttattatgctagc

SEQ ID NO: 1398724 - DNA, 22 bp, Artificial Sequence
  chemically synthesized
tcattaccatggctagcataat

SEQ ID NO: 1398725 - DNA, 22 bp, Artificial Sequence
  chemically synthesized
ctttctgtttttattatgctag

SEQ ID NO: 1398726 - DNA, 22 bp, Artificial Sequence
  chemically synthesized
tctttctgtttttattatgcta

SEQ ID NO: 1398727 - DNA, 22 bp, Artificial Sequence
  chemically synthesized
ttttctttctgtttttattatg

SEQ ID NO: 1398728 - DNA, 22 bp, Artificial Sequence
  chemically synthesized
ccatggctagcataataaaaac

SEQ ID NO: 1398729 - DNA, 22 bp, Artificial Sequence
  chemically synthesized
ttattttctttctgtttttatt

SEQ ID NO: 1398730 - DNA, 22 bp, Artificial Sequence
  chemically synthesized
attattttctttctgtttttat

SEQ ID NO: 1398731 - DNA, 22 bp, Artificial Sequence
  chemically synthesized
cttattattttctttctgtttt

SEQ ID NO: 1398732 - DNA, 22 bp, Artificial Sequence
  chemically synthesized
gcataataaaaacagaaagaaa

SEQ ID NO: 1398733 - DNA, 22 bp, Artificial Sequence
  chemically synthesized
tatctccttattattttctttc

SEQ ID NO: 1398734 - DNA, 22 bp, Artificial Sequence
  chemically synthesized
gtatctccttattattttcttt

SEQ ID NO: 1398735 - DNA, 22 bp, Artificial Sequence
  chemically synthesized
tgtatctccttattattttctt

SEQ ID NO: 1398736 - DNA, 22 bp, Artificial Sequence
  chemically synthesized
ttttgtatctccttattatttt

SEQ ID NO: 1398737 - DNA, 22 bp, Artificial Sequence
  chemically synthesized
cccatctgttttgtatctcctt

SEQ ID NO: 1398738 - DNA, 22 bp, Artificial Sequence
  chemically synthesized
gcccatctgttttgtatctcct

SEQ ID NO: 1398739 - DNA, 22 bp, Artificial Sequence
  chemically synthesized
ttgcccatctgttttgtatctc

SEQ ID NO: 1398740 - DNA, 22 bp, Artificial Sequence
  chemically synthesized
cttgcccatctgttttgtatct

SEQ ID NO: 1398741 - DNA, 22 bp, Artificial Sequence
  chemically synthesized
tcttgcccatctgttttgtatc

SEQ ID NO: 1398742 - DNA, 22 bp, Artificial Sequence
  chemically synthesized
ttcttgcccatctgttttgtat

SEQ ID NO: 1398743 - DNA, 22 bp, Artificial Sequence
  chemically synthesized
tttcttgcccatctgttttgta

SEQ ID NO: 1398744 - DNA, 22 bp, Artificial Sequence
  chemically synthesized
tttttcttgcccatctgttttg

SEQ ID NO: 1398745 - DNA, 22 bp, Artificial Sequence
  chemically synthesized
aaaattctttttcttgcccatc

SEQ ID NO: 1398746 - DNA, 22 bp, Artificial Sequence
  chemically synthesized
gaaaattctttttcttgcccat

SEQ ID NO: 1398747 - DNA, 22 bp, Artificial Sequence
  chemically synthesized
ttgaaaattctttttcttgccc

SEQ ID NO: 1398748 - DNA, 22 bp, Artificial Sequence
  chemically synthesized
cttgaaaattctttttcttgcc

SEQ ID NO: 1398749 - DNA, 22 bp, Artificial Sequence
  chemically synthesized
acatttcttgaaaattcttttt

SEQ ID NO: 1398750 - DNA, 22 bp, Artificial Sequence
  chemically synthesized
cacatttcttgaaaattctttt

SEQ ID NO: 1398751 - DNA, 22 bp, Artificial Sequence
  chemically synthesized
ccttcacatttcttgaaaattc

SEQ ID NO: 1398752 - DNA, 22 bp, Artificial Sequence
  chemically synthesized
cccttcacatttcttgaaaatt

SEQ ID NO: 1398753 - DNA, 22 bp, Artificial Sequence
  chemically synthesized
tttcccttcacatttcttgaaa

SEQ ID NO: 1398754 - DNA, 22 bp, Artificial Sequence
  chemically synthesized
ctatttcccttcacatttcttg

SEQ ID NO: 1398755 - DNA, 22 bp, Artificial Sequence
  chemically synthesized
actatttcccttcacatttctt

SEQ ID NO: 1398756 - DNA, 22 bp, Artificial Sequence
  chemically synthesized
tactatttcccttcacatttct

SEQ ID NO: 1398757 - DNA, 22 bp, Artificial Sequence
  chemically synthesized
tttactatttcccttcacattt

SEQ ID NO: 1398758 - DNA, 22 bp, Artificial Sequence
  chemically synthesized
tctttactatttcccttcacat

SEQ ID NO: 1398759 - DNA, 22 bp, Artificial Sequence
  chemically synthesized
ctctttactatttcccttcaca

SEQ ID NO: 1398760 - DNA, 22 bp, Artificial Sequence
  chemically synthesized
tctctttactatttcccttcac

SEQ ID NO: 1398761 - DNA, 22 bp, Artificial Sequence
  chemically synthesized
tcaagaaatgtgaagggaaata

SEQ ID NO: 1398762 - DNA, 22 bp, Artificial Sequence
  chemically synthesized
caagaaatgtgaagggaaatag

SEQ ID NO: 1398763 - DNA, 22 bp, Artificial Sequence
  chemically synthesized
aagaaatgtgaagggaaatagt

SEQ ID NO: 1398764 - DNA, 22 bp, Artificial Sequence
  chemically synthesized
aatagtctttctctttactatt

SEQ ID NO: 1398765 - DNA, 22 bp, Artificial Sequence
  chemically synthesized
aaatagtctttctctttactat

SEQ ID NO: 1398766 - DNA, 22 bp, Artificial Sequence
  chemically synthesized
atcttaaatagtctttctcttt

SEQ ID NO: 1398767 - DNA, 22 bp, Artificial Sequence
  chemically synthesized
catcttaaatagtctttctctt

SEQ ID NO: 1398768 - DNA, 22 bp, Artificial Sequence
  chemically synthesized
tcatcttaaatagtctttctct

SEQ ID NO: 1398769 - DNA, 22 bp, Artificial Sequence
  chemically synthesized
ttcatcttaaatagtctttctc

SEQ ID NO: 1398770 - DNA, 22 bp, Artificial Sequence
  chemically synthesized
acatttttcatcttaaatagtc

SEQ ID NO: 1398771 - DNA, 22 bp, Artificial Sequence
  chemically synthesized
atattaacatttttcatcttaa

SEQ ID NO: 1398772 - DNA, 22 bp, Artificial Sequence
  chemically synthesized
tcatattaacatttttcatctt

SEQ ID NO: 1398773 - DNA, 22 bp, Artificial Sequence
  chemically synthesized
ctcatattaacatttttcatct

SEQ ID NO: 1398774 - DNA, 22 bp, Artificial Sequence
  chemically synthesized
tctcatattaacatttttcatc

SEQ ID NO: 1398775 - DNA, 22 bp, Artificial Sequence
  chemically synthesized
attttctcatattaacattttt

SEQ ID NO: 1398776 - DNA, 22 bp, Artificial Sequence
  chemically synthesized
gattttctcatattaacatttt

SEQ ID NO: 1398777 - DNA, 22 bp, Artificial Sequence
  chemically synthesized
tttaagatgaaaaatgttaata

SEQ ID NO: 1398778 - DNA, 22 bp, Artificial Sequence
  chemically synthesized
aagatgaaaaatgttaatatga

SEQ ID NO: 1398779 - DNA, 22 bp, Artificial Sequence
  chemically synthesized
agatgaaaaatgttaatatgag

SEQ ID NO: 1398780 - DNA, 22 bp, Artificial Sequence
  chemically synthesized
atcatttgattttctcatatta

SEQ ID NO: 1398781 - DNA, 22 bp, Artificial Sequence
  chemically synthesized
catcatttgattttctcatatt

SEQ ID NO: 1398782 - DNA, 22 bp, Artificial Sequence
  chemically synthesized
tcatcatttgattttctcatat

SEQ ID NO: 1398783 - DNA, 22 bp, Artificial Sequence
  chemically synthesized
ttcatcatttgattttctcata

SEQ ID NO: 1398784 - DNA, 22 bp, Artificial Sequence
  chemically synthesized
tttttcatcatttgattttctc

SEQ ID NO: 1398785 - DNA, 22 bp, Artificial Sequence
  chemically synthesized
ctatttttcatcatttgatttt

SEQ ID NO: 1398786 - DNA, 22 bp, Artificial Sequence
  chemically synthesized
gctatttttcatcatttgattt

SEQ ID NO: 1398787 - DNA, 22 bp, Artificial Sequence
  chemically synthesized
atatgagaaaatcaaatgatga

SEQ ID NO: 1398788 - DNA, 22 bp, Artificial Sequence
  chemically synthesized
aaaaaaaaaacttgctattttt

SEQ ID NO: 1398789 - DNA, 22 bp, Artificial Sequence
  chemically synthesized
ctaaaaaaaaaaacttgctatt

SEQ ID NO: 1398790 - DNA, 22 bp, Artificial Sequence
  chemically synthesized
gctaaaaaaaaaaacttgctat

SEQ ID NO: 1398791 - DNA, 22 bp, Artificial Sequence
  chemically synthesized
ttgctaaaaaaaaaaacttgct

SEQ ID NO: 1398792 - DNA, 22 bp, Artificial Sequence
  chemically synthesized
tcttgctaaaaaaaaaaacttg

SEQ ID NO: 1398793 - DNA, 22 bp, Artificial Sequence
  chemically synthesized
tgaagaataaattctcttgcta

SEQ ID NO: 1398794 - DNA, 22 bp, Artificial Sequence
  chemically synthesized
tatgaagaataaattctcttgc

SEQ ID NO: 1398795 - DNA, 22 bp, Artificial Sequence
  chemically synthesized
ttttttttagcaagagaattta

SEQ ID NO: 1398796 - DNA, 22 bp, Artificial Sequence
  chemically synthesized
tttttttagcaagagaatttat

SEQ ID NO: 1398797 - DNA, 22 bp, Artificial Sequence
  chemically synthesized
ttttttagcaagagaatttatt

SEQ ID NO: 1398798 - DNA, 22 bp, Artificial Sequence
  chemically synthesized
tttttagcaagagaatttattc

SEQ ID NO: 1398799 - DNA, 22 bp, Artificial Sequence
  chemically synthesized
ttttagcaagagaatttattct

SEQ ID NO: 1398800 - DNA, 22 bp, Artificial Sequence
  chemically synthesized
tttagcaagagaatttattctt

SEQ ID NO: 1398801 - DNA, 22 bp, Artificial Sequence
  chemically synthesized
ttagcaagagaatttattcttc

SEQ ID NO: 1398802 - DNA, 22 bp, Artificial Sequence
  chemically synthesized
tagcaagagaatttattcttca

SEQ ID NO: 1398803 - DNA, 22 bp, Artificial Sequence
  chemically synthesized
agcaagagaatttattcttcat

SEQ ID NO: 1398804 - DNA, 22 bp, Artificial Sequence
  chemically synthesized
gcaagagaatttattcttcata

SEQ ID NO: 1398805 - DNA, 22 bp, Artificial Sequence
  chemically synthesized
aataaatgtcatacaggttcta

SEQ ID NO: 1398806 - DNA, 22 bp, Artificial Sequence
  chemically synthesized
aaataaatgtcatacaggttct

SEQ ID NO: 1398807 - DNA, 22 bp, Artificial Sequence
  chemically synthesized
ttaaataaatgtcatacaggtt

SEQ ID NO: 1398808 - DNA, 22 bp, Artificial Sequence
  chemically synthesized
attcttcatagaacctgtatga

SEQ ID NO: 1398809 - DNA, 22 bp, Artificial Sequence
  chemically synthesized
cttaaataaatgtcatacaggt

SEQ ID NO: 1398810 - DNA, 22 bp, Artificial Sequence
  chemically synthesized
ttcttcatagaacctgtatgac

SEQ ID NO: 1398811 - DNA, 22 bp, Artificial Sequence
  chemically synthesized
ttcatagaacctgtatgacatt

SEQ ID NO: 1398812 - DNA, 22 bp, Artificial Sequence
  chemically synthesized
tgtttcttaaataaatgtcata

SEQ ID NO: 1398813 - DNA, 22 bp, Artificial Sequence
  chemically synthesized
catagaacctgtatgacattta

SEQ ID NO: 1398814 - DNA, 22 bp, Artificial Sequence
  chemically synthesized
atagaacctgtatgacatttat

SEQ ID NO: 1398815 - DNA, 22 bp, Artificial Sequence
  chemically synthesized
tgtgtttcttaaataaatgtca

SEQ ID NO: 1398816 - DNA, 22 bp, Artificial Sequence
  chemically synthesized
tatgacatttatttaagaaaca

SEQ ID NO: 1398817 - DNA, 22 bp, Artificial Sequence
  chemically synthesized
aaatgacaccattctgtgtttc

SEQ ID NO: 1398818 - DNA, 22 bp, Artificial Sequence
  chemically synthesized
atttaagaaacacagaatggtg

SEQ ID NO: 1398819 - DNA, 22 bp, Artificial Sequence
  chemically synthesized
tttaagaaacacagaatggtgt

SEQ ID NO: 1398820 - DNA, 22 bp, Artificial Sequence
  chemically synthesized
aagaaacacagaatggtgtcat

SEQ ID NO: 1398821 - DNA, 22 bp, Artificial Sequence
  chemically synthesized
agaaacacagaatggtgtcatt

SEQ ID NO: 1398822 - DNA, 22 bp, Artificial Sequence
  chemically synthesized
taccaccagtacaaggaatgtc

SEQ ID NO: 1398823 - DNA, 22 bp, Artificial Sequence
  chemically synthesized
caatttcatgacattccttgta

SEQ ID NO: 1398824 - DNA, 22 bp, Artificial Sequence
  chemically synthesized
aatttcatgacattccttgtac

SEQ ID NO: 1398825 - DNA, 22 bp, Artificial Sequence
  chemically synthesized
catgacattccttgtactggtg

SEQ ID NO: 1398826 - DNA, 22 bp, Artificial Sequence
  chemically synthesized
atgacattccttgtactggtgg

SEQ ID NO: 1398827 - DNA, 22 bp, Artificial Sequence
  chemically synthesized
tgtataaaaaattgtaccacca

SEQ ID NO: 1398828 - DNA, 22 bp, Artificial Sequence
  chemically synthesized
ctgtgtataaaaaattgtacca

SEQ ID NO: 1398829 - DNA, 22 bp, Artificial Sequence
  chemically synthesized
cttgtactggtggtacaatttt

SEQ ID NO: 1398830 - DNA, 22 bp, Artificial Sequence
  chemically synthesized
ttcctgtgtataaaaaattgta

SEQ ID NO: 1398831 - DNA, 22 bp, Artificial Sequence
  chemically synthesized
attcctgtgtataaaaaattgt

SEQ ID NO: 1398832 - DNA, 22 bp, Artificial Sequence
  chemically synthesized
gtactggtggtacaatttttta

SEQ ID NO: 1398833 - DNA, 22 bp, Artificial Sequence
  chemically synthesized
tattcctgtgtataaaaaattg

SEQ ID NO: 1398834 - DNA, 22 bp, Artificial Sequence
  chemically synthesized
tactggtggtacaattttttat

SEQ ID NO: 1398835 - DNA, 22 bp, Artificial Sequence
  chemically synthesized
ttattcctgtgtataaaaaatt

SEQ ID NO: 1398836 - DNA, 22 bp, Artificial Sequence
  chemically synthesized
tttattcctgtgtataaaaaat

SEQ ID NO: 1398837 - DNA, 22 bp, Artificial Sequence
  chemically synthesized
ttttattcctgtgtataaaaaa

SEQ ID NO: 1398838 - DNA, 22 bp, Artificial Sequence
  chemically synthesized
gtggtacaattttttatacaca

SEQ ID NO: 1398839 - DNA, 22 bp, Artificial Sequence
  chemically synthesized
cttttttattcctgtgtataaa

SEQ ID NO: 1398840 - DNA, 22 bp, Artificial Sequence
  chemically synthesized
ttccttttttattcctgtgtat

SEQ ID NO: 1398841 - DNA, 22 bp, Artificial Sequence
  chemically synthesized
attccttttttattcctgtgta

SEQ ID NO: 1398842 - DNA, 22 bp, Artificial Sequence
  chemically synthesized
tattccttttttattcctgtgt

SEQ ID NO: 1398843 - DNA, 22 bp, Artificial Sequence
  chemically synthesized
ttattccttttttattcctgtg

SEQ ID NO: 1398844 - DNA, 22 bp, Artificial Sequence
  chemically synthesized
tttattccttttttattcctgt

SEQ ID NO: 1398845 - DNA, 22 bp, Artificial Sequence
  chemically synthesized
ttttattccttttttattcctg

SEQ ID NO: 1398846 - DNA, 22 bp, Artificial Sequence
  chemically synthesized
cttttttattccttttttattc

SEQ ID NO: 1398847 - DNA, 22 bp, Artificial Sequence
  chemically synthesized
tttatacacaggaataaaaaag

SEQ ID NO: 1398848 - DNA, 22 bp, Artificial Sequence
  chemically synthesized
acttttttattccttttttatt

SEQ ID NO: 1398849 - DNA, 22 bp, Artificial Sequence
  chemically synthesized
ttatacacaggaataaaaaagg

SEQ ID NO: 1398850 - DNA, 22 bp, Artificial Sequence
  chemically synthesized
tacttttttattccttttttat

SEQ ID NO: 1398851 - DNA, 22 bp, Artificial Sequence
  chemically synthesized
tatacacaggaataaaaaagga

SEQ ID NO: 1398852 - DNA, 22 bp, Artificial Sequence
  chemically synthesized
ttacttttttattcctttttta

SEQ ID NO: 1398853 - DNA, 22 bp, Artificial Sequence
  chemically synthesized
atacacaggaataaaaaaggaa

SEQ ID NO: 1398854 - DNA, 22 bp, Artificial Sequence
  chemically synthesized
tacacaggaataaaaaaggaat

SEQ ID NO: 1398855 - DNA, 22 bp, Artificial Sequence
  chemically synthesized
tccttttacttttttattcctt

SEQ ID NO: 1398856 - DNA, 22 bp, Artificial Sequence
  chemically synthesized
atccttttacttttttattcct

SEQ ID NO: 1398857 - DNA, 22 bp, Artificial Sequence
  chemically synthesized
tttatccttttacttttttatt

SEQ ID NO: 1398858 - DNA, 22 bp, Artificial Sequence
  chemically synthesized
tgttatttatccttttactttt

SEQ ID NO: 1398859 - DNA, 22 bp, Artificial Sequence
  chemically synthesized
aactatgttatttatcctttta

SEQ ID NO: 1398860 - DNA, 22 bp, Artificial Sequence
  chemically synthesized
aggactcaactatgttatttat

SEQ ID NO: 1398861 - DNA, 22 bp, Artificial Sequence
  chemically synthesized
tcaggactcaactatgttattt

SEQ ID NO: 1398862 - DNA, 22 bp, Artificial Sequence
  chemically synthesized
ctcaggactcaactatgttatt

SEQ ID NO: 1398863 - DNA, 22 bp, Artificial Sequence
  chemically synthesized
tctcaggactcaactatgttat

SEQ ID NO: 1398864 - DNA, 22 bp, Artificial Sequence
  chemically synthesized
aaacccgtgttttctcaggact

SEQ ID NO: 1398865 - DNA, 22 bp, Artificial Sequence
  chemically synthesized
agtcctgagaaaacacgggttt

SEQ ID NO: 1398866 - DNA, 22 bp, Artificial Sequence
  chemically synthesized
agaaaacacgggtttgaactgc

SEQ ID NO: 1398867 - DNA, 22 bp, Artificial Sequence
  chemically synthesized
gaactgcatgggtccacttaca

SEQ ID NO: 1398868 - DNA, 22 bp, Artificial Sequence
  chemically synthesized
aaaaaaatggcatgtaagtgga

SEQ ID NO: 1398869 - DNA, 22 bp, Artificial Sequence
  chemically synthesized
aactgcatgggtccacttacat

SEQ ID NO: 1398870 - DNA, 22 bp, Artificial Sequence
  chemically synthesized
gttgaaaaaaatggcatgtaag

SEQ ID NO: 1398871 - DNA, 22 bp, Artificial Sequence
  chemically synthesized
catgggtccacttacatgccat

SEQ ID NO: 1398872 - DNA, 22 bp, Artificial Sequence
  chemically synthesized
agtctggttgaaaaaaatggca

SEQ ID NO: 1398873 - DNA, 22 bp, Artificial Sequence
  chemically synthesized
atctgagtctggttgaaaaaaa

SEQ ID NO: 1398874 - DNA, 22 bp, Artificial Sequence
  chemically synthesized
gatctgagtctggttgaaaaaa

SEQ ID NO: 1398875 - DNA, 22 bp, Artificial Sequence
  chemically synthesized
tgatctgagtctggttgaaaaa

SEQ ID NO: 1398876 - DNA, 22 bp, Artificial Sequence
  chemically synthesized
ttgatctgagtctggttgaaaa

SEQ ID NO: 1398877 - DNA, 22 bp, Artificial Sequence
  chemically synthesized
acatgccatttttttcaaccag

SEQ ID NO: 1398878 - DNA, 22 bp, Artificial Sequence
  chemically synthesized
catgccatttttttcaaccaga

SEQ ID NO: 1398879 - DNA, 22 bp, Artificial Sequence
  chemically synthesized
tatttttgatctgagtctggtt

SEQ ID NO: 1398880 - DNA, 22 bp, Artificial Sequence
  chemically synthesized
ttttcaaccagactcagatcaa

SEQ ID NO: 1398881 - DNA, 22 bp, Artificial Sequence
  chemically synthesized
tttcaaccagactcagatcaaa

SEQ ID NO: 1398882 - DNA, 22 bp, Artificial Sequence
  chemically synthesized
ttcaaccagactcagatcaaaa

SEQ ID NO: 1398883 - DNA, 22 bp, Artificial Sequence
  chemically synthesized
cgaatactgtatttttgatctg

SEQ ID NO: 1398884 - DNA, 22 bp, Artificial Sequence
  chemically synthesized
tcaaccagactcagatcaaaaa

SEQ ID NO: 1398885 - DNA, 22 bp, Artificial Sequence
  chemically synthesized
caaccagactcagatcaaaaat

SEQ ID NO: 1398886 - DNA, 22 bp, Artificial Sequence
  chemically synthesized
tgcgaatactgtatttttgatc

SEQ ID NO: 1398887 - DNA, 22 bp, Artificial Sequence
  chemically synthesized
aaccagactcagatcaaaaata

SEQ ID NO: 1398888 - DNA, 22 bp, Artificial Sequence
  chemically synthesized
acattctgcgaatactgtattt

SEQ ID NO: 1398889 - DNA, 22 bp, Artificial Sequence
  chemically synthesized
cacattctgcgaatactgtatt

SEQ ID NO: 1398890 - DNA, 22 bp, Artificial Sequence
  chemically synthesized
agatcaaaaatacagtattcgc

SEQ ID NO: 1398891 - DNA, 22 bp, Artificial Sequence
  chemically synthesized
tatacgtaggtttcacattctg

SEQ ID NO: 1398892 - DNA, 22 bp, Artificial Sequence
  chemically synthesized
tatatacgtaggtttcacattc

SEQ ID NO: 1398893 - DNA, 22 bp, Artificial Sequence
  chemically synthesized
gccctctatatacgtaggtttc

SEQ ID NO: 1398894 - DNA, 22 bp, Artificial Sequence
  chemically synthesized
gcagaatgtgaaacctacgtat

SEQ ID NO: 1398895 - DNA, 22 bp, Artificial Sequence
  chemically synthesized
cgtatatagagggccaattttg

SEQ ID NO: 1398896 - DNA, 22 bp, Artificial Sequence
  chemically synthesized
cagaacccgcacacaggcaaaa

SEQ ID NO: 1398897 - DNA, 22 bp, Artificial Sequence
  chemically synthesized
tgcagaacccgcacacaggcaa

SEQ ID NO: 1398898 - DNA, 22 bp, Artificial Sequence
  chemically synthesized
acagccaactctgcagaacccg

SEQ ID NO: 1398899 - DNA, 22 bp, Artificial Sequence
  chemically synthesized
cacagccaactctgcagaaccc

SEQ ID NO: 1398900 - DNA, 22 bp, Artificial Sequence
  chemically synthesized
tgcctgtgtgcgggttctgcag

SEQ ID NO: 1398901 - DNA, 22 bp, Artificial Sequence
  chemically synthesized
gcctgtgtgcgggttctgcaga

SEQ ID NO: 1398902 - DNA, 22 bp, Artificial Sequence
  chemically synthesized
cctgtgtgcgggttctgcagag

SEQ ID NO: 1398903 - DNA, 22 bp, Artificial Sequence
  chemically synthesized
acatttcacagccaactctgca

SEQ ID NO: 1398904 - DNA, 22 bp, Artificial Sequence
  chemically synthesized
tgtgcgggttctgcagagttgg

SEQ ID NO: 1398905 - DNA, 22 bp, Artificial Sequence
  chemically synthesized
aacatactcacatttcacagcc

SEQ ID NO: 1398906 - DNA, 22 bp, Artificial Sequence
  chemically synthesized
tgcagagttggctgtgaaatgt

SEQ ID NO: 1398907 - DNA, 22 bp, Artificial Sequence
  chemically synthesized
cagagttggctgtgaaatgtga

SEQ ID NO: 1398908 - DNA, 22 bp, Artificial Sequence
  chemically synthesized
gctgtgaaatgtgagtatgttc

SEQ ID NO: 1398909 - DNA, 22 bp, Artificial Sequence
  chemically synthesized
tgaaatgtgagtatgttcagat

SEQ ID NO: 1398910 - DNA, 22 bp, Artificial Sequence
  chemically synthesized
atgtataccaaaatctgaacat

SEQ ID NO: 1398911 - DNA, 22 bp, Artificial Sequence
  chemically synthesized
tcatgtataccaaaatctgaac

SEQ ID NO: 1398912 - DNA, 22 bp, Artificial Sequence
  chemically synthesized
cagtactctcatgtataccaaa

SEQ ID NO: 1398913 - DNA, 22 bp, Artificial Sequence
  chemically synthesized
gttccagtactctcatgtatac

SEQ ID NO: 1398914 - DNA, 22 bp, Artificial Sequence
  chemically synthesized
agattttggtatacatgagagt

SEQ ID NO: 1398915 - DNA, 22 bp, Artificial Sequence
  chemically synthesized
tggtatacatgagagtactgga

SEQ ID NO: 1398916 - DNA, 22 bp, Artificial Sequence
  chemically synthesized
ggtatacatgagagtactggaa

SEQ ID NO: 1398917 - DNA, 22 bp, Artificial Sequence
  chemically synthesized
gtatacatgagagtactggaac

SEQ ID NO: 1398918 - DNA, 22 bp, Artificial Sequence
  chemically synthesized
agcatgcacgtggtattggttc

SEQ ID NO: 1398919 - DNA, 22 bp, Artificial Sequence
  chemically synthesized
tccctcagcatgcacgtggtat

SEQ ID NO: 1398920 - DNA, 22 bp, Artificial Sequence
  chemically synthesized
gaaccaataccacgtgcatgct

SEQ ID NO: 1398921 - DNA, 22 bp, Artificial Sequence
  chemically synthesized
tatacagttgtccctcagcatg

SEQ ID NO: 1398922 - DNA, 22 bp, Artificial Sequence
  chemically synthesized
ccaactatatacagttgtccct

SEQ ID NO: 1398923 - DNA, 22 bp, Artificial Sequence
  chemically synthesized
tacagctcccaactatatacag

SEQ ID NO: 1398924 - DNA, 22 bp, Artificial Sequence
  chemically synthesized
gtacagctcccaactatataca

SEQ ID NO: 1398925 - DNA, 22 bp, Artificial Sequence
  chemically synthesized
agggacaactgtatatagttgg

SEQ ID NO: 1398926 - DNA, 22 bp, Artificial Sequence
  chemically synthesized
tatatttgtacagctcccaact

SEQ ID NO: 1398927 - DNA, 22 bp, Artificial Sequence
  chemically synthesized
tatatagttgggagctgtacaa

SEQ ID NO: 1398928 - DNA, 22 bp, Artificial Sequence
  chemically synthesized
ggagctgtacaaatatataact

SEQ ID NO: 1398929 - DNA, 22 bp, Artificial Sequence
  chemically synthesized
agacatgagtaaagttatatat

SEQ ID NO: 1398930 - DNA, 22 bp, Artificial Sequence
  chemically synthesized
taagacatgagtaaagttatat

SEQ ID NO: 1398931 - DNA, 22 bp, Artificial Sequence
  chemically synthesized
tacaaatatataactttactca

SEQ ID NO: 1398932 - DNA, 22 bp, Artificial Sequence
  chemically synthesized
ggttctaagacatgagtaaagt

SEQ ID NO: 1398933 - DNA, 22 bp, Artificial Sequence
  chemically synthesized
gggttctaagacatgagtaaag

SEQ ID NO: 1398934 - DNA, 22 bp, Artificial Sequence
  chemically synthesized
tatttgggttctaagacatgag

SEQ ID NO: 1398935 - DNA, 22 bp, Artificial Sequence
  chemically synthesized
gctgtatttgggttctaagaca

SEQ ID NO: 1398936 - DNA, 22 bp, Artificial Sequence
  chemically synthesized
agctgtatttgggttctaagac

SEQ ID NO: 1398937 - DNA, 22 bp, Artificial Sequence
  chemically synthesized
tttagctgtatttgggttctaa

SEQ ID NO: 1398938 - DNA, 22 bp, Artificial Sequence
  chemically synthesized
tactcatgtcttagaacccaaa

SEQ ID NO: 1398939 - DNA, 22 bp, Artificial Sequence
  chemically synthesized
actcatgtcttagaacccaaat

SEQ ID NO: 1398940 - DNA, 22 bp, Artificial Sequence
  chemically synthesized
ctcatgtcttagaacccaaata

SEQ ID NO: 1398941 - DNA, 22 bp, Artificial Sequence
  chemically synthesized
atgtcttagaacccaaatacag

SEQ ID NO: 1398942 - DNA, 22 bp, Artificial Sequence
  chemically synthesized
tgcaggtgtattatttagctgt

SEQ ID NO: 1398943 - DNA, 22 bp, Artificial Sequence
  chemically synthesized
agaacccaaatacagctaaata

SEQ ID NO: 1398944 - DNA, 22 bp, Artificial Sequence
  chemically synthesized
gaacccaaatacagctaaataa

SEQ ID NO: 1398945 - DNA, 22 bp, Artificial Sequence
  chemically synthesized
aagttatgcaggtgtattattt

SEQ ID NO: 1398946 - DNA, 22 bp, Artificial Sequence
  chemically synthesized
aataatacacctgcataacttg

SEQ ID NO: 1398947 - DNA, 22 bp, Artificial Sequence
  chemically synthesized
aaaacccagaacgacattcaag

SEQ ID NO: 1398948 - DNA, 22 bp, Artificial Sequence
  chemically synthesized
cataacttgaatgtcgttctgg

SEQ ID NO: 1398949 - DNA, 22 bp, Artificial Sequence
  chemically synthesized
caacagtactaaaaacccagaa

SEQ ID NO: 1398950 - DNA, 22 bp, Artificial Sequence
  chemically synthesized
ccaacagtactaaaaacccaga

SEQ ID NO: 1398951 - DNA, 22 bp, Artificial Sequence
  chemically synthesized
tccaacagtactaaaaacccag

SEQ ID NO: 1398952 - DNA, 22 bp, Artificial Sequence
  chemically synthesized
gaatgtcgttctgggtttttag

SEQ ID NO: 1398953 - DNA, 22 bp, Artificial Sequence
  chemically synthesized
aatgtcgttctgggtttttagt

SEQ ID NO: 1398954 - DNA, 22 bp, Artificial Sequence
  chemically synthesized
cactttccaacagtactaaaaa

SEQ ID NO: 1398955 - DNA, 22 bp, Artificial Sequence
  chemically synthesized
tgggtttttagtactgttggaa

SEQ ID NO: 1398956 - DNA, 22 bp, Artificial Sequence
  chemically synthesized
ggtttttagtactgttggaaag

SEQ ID NO: 1398957 - DNA, 22 bp, Artificial Sequence
  chemically synthesized
ttagtactgttggaaagtgtag

SEQ ID NO: 1398958 - DNA, 22 bp, Artificial Sequence
  chemically synthesized
tagtactgttggaaagtgtaga

SEQ ID NO: 1398959 - DNA, 22 bp, Artificial Sequence
  chemically synthesized
catagtgtagggtctacacttt

SEQ ID NO: 1398960 - DNA, 22 bp, Artificial Sequence
  chemically synthesized
agtactgttggaaagtgtagac

SEQ ID NO: 1398961 - DNA, 22 bp, Artificial Sequence
  chemically synthesized
gcatagtgtagggtctacactt

SEQ ID NO: 1398962 - DNA, 22 bp, Artificial Sequence
  chemically synthesized
gtactgttggaaagtgtagacc

SEQ ID NO: 1398963 - DNA, 22 bp, Artificial Sequence
  chemically synthesized
ttggaaagtgtagaccctacac

SEQ ID NO: 1398964 - DNA, 22 bp, Artificial Sequence
  chemically synthesized
gaaagtgtagaccctacactat

SEQ ID NO: 1398965 - DNA, 22 bp, Artificial Sequence
  chemically synthesized
atccaacccacttgcatagtgt

SEQ ID NO: 1398966 - DNA, 22 bp, Artificial Sequence
  chemically synthesized
catccaacccacttgcatagtg

SEQ ID NO: 1398967 - DNA, 22 bp, Artificial Sequence
  chemically synthesized
tcatccttcatccaacccactt

SEQ ID NO: 1398968 - DNA, 22 bp, Artificial Sequence
  chemically synthesized
cactatgcaagtgggttggatg

SEQ ID NO: 1398969 - DNA, 22 bp, Artificial Sequence
  chemically synthesized
cacattgtcatccttcatccaa

SEQ ID NO: 1398970 - DNA, 22 bp, Artificial Sequence
  chemically synthesized
tgcaagtgggttggatgaagga

SEQ ID NO: 1398971 - DNA, 22 bp, Artificial Sequence
  chemically synthesized
actgcacattgtcatccttcat

SEQ ID NO: 1398972 - DNA, 22 bp, Artificial Sequence
  chemically synthesized
gactgcacattgtcatccttca

SEQ ID NO: 1398973 - DNA, 22 bp, Artificial Sequence
  chemically synthesized
gatgaaggatgacaatgtgcag

SEQ ID NO: 1398974 - DNA, 22 bp, Artificial Sequence
  chemically synthesized
tagaaacacagtgaataacaag

SEQ ID NO: 1398975 - DNA, 22 bp, Artificial Sequence
  chemically synthesized
atagaaacacagtgaataacaa

SEQ ID NO: 1398976 - DNA, 22 bp, Artificial Sequence
  chemically synthesized
tatagaaacacagtgaataaca

SEQ ID NO: 1398977 - DNA, 22 bp, Artificial Sequence
  chemically synthesized
acagtgactttatagaaacaca

SEQ ID NO: 1398978 - DNA, 22 bp, Artificial Sequence
  chemically synthesized
gttattcactgtgtttctataa

SEQ ID NO: 1398979 - DNA, 22 bp, Artificial Sequence
  chemically synthesized
ttattcactgtgtttctataaa

SEQ ID NO: 1398980 - DNA, 22 bp, Artificial Sequence
  chemically synthesized
ttcactgtgtttctataaagtc

SEQ ID NO: 1398981 - DNA, 22 bp, Artificial Sequence
  chemically synthesized
agtgttcacagtgactttatag

SEQ ID NO: 1398982 - DNA, 22 bp, Artificial Sequence
  chemically synthesized
actgtgtttctataaagtcact

SEQ ID NO: 1398983 - DNA, 22 bp, Artificial Sequence
  chemically synthesized
attcagtgttcacagtgacttt

SEQ ID NO: 1398984 - DNA, 22 bp, Artificial Sequence
  chemically synthesized
tgtttctataaagtcactgtga

SEQ ID NO: 1398985 - DNA, 22 bp, Artificial Sequence
  chemically synthesized
actaattcagtgttcacagtga

SEQ ID NO: 1398986 - DNA, 22 bp, Artificial Sequence
  chemically synthesized
ctataaagtcactgtgaacact

SEQ ID NO: 1398987 - DNA, 22 bp, Artificial Sequence
  chemically synthesized
tataaagtcactgtgaacactg

SEQ ID NO: 1398988 - DNA, 22 bp, Artificial Sequence
  chemically synthesized
taaagtcactgtgaacactgaa

SEQ ID NO: 1398989 - DNA, 22 bp, Artificial Sequence
  chemically synthesized
agtattcactaattcagtgttc

SEQ ID NO: 1398990 - DNA, 22 bp, Artificial Sequence
  chemically synthesized
cagtattcactaattcagtgtt

SEQ ID NO: 1398991 - DNA, 22 bp, Artificial Sequence
  chemically synthesized
tgaacactgaattagtgaatac

SEQ ID NO: 1398992 - DNA, 22 bp, Artificial Sequence
  chemically synthesized
ggaggaatgcttcagtattcac

SEQ ID NO: 1398993 - DNA, 22 bp, Artificial Sequence
  chemically synthesized
ctgggaggaatgcttcagtatt

SEQ ID NO: 1398994 - DNA, 22 bp, Artificial Sequence
  chemically synthesized
tcctgggaggaatgcttcagta

SEQ ID NO: 1398995 - DNA, 22 bp, Artificial Sequence
  chemically synthesized
ctcctgggaggaatgcttcagt

SEQ ID NO: 1398996 - DNA, 22 bp, Artificial Sequence
  chemically synthesized
aattagtgaatactgaagcatt

SEQ ID NO: 1398997 - DNA, 22 bp, Artificial Sequence
  chemically synthesized
tatttctcctgggaggaatgct

SEQ ID NO: 1398998 - DNA, 22 bp, Artificial Sequence
  chemically synthesized
gtgaatactgaagcattcctcc

SEQ ID NO: 1398999 - DNA, 22 bp, Artificial Sequence
  chemically synthesized
tcattgtatttctcctgggagg

SEQ ID NO: 1399000 - DNA, 22 bp, Artificial Sequence
  chemically synthesized
aagcattcctcccaggagaaat

SEQ ID NO: 1399001 - DNA, 22 bp, Artificial Sequence
  chemically synthesized
ccagaaatctatcattgtattt

SEQ ID NO: 1399002 - DNA, 22 bp, Artificial Sequence
  chemically synthesized
ctcccaggagaaatacaatgat

SEQ ID NO: 1399003 - DNA, 22 bp, Artificial Sequence
  chemically synthesized
ccaggagaaatacaatgataga

SEQ ID NO: 1399004 - DNA, 22 bp, Artificial Sequence
  chemically synthesized
tgagcagaggctcccagaaatc

SEQ ID NO: 1399005 - DNA, 22 bp, Artificial Sequence
  chemically synthesized
acaaaaatgttatgagcagagg

SEQ ID NO: 1399006 - DNA, 22 bp, Artificial Sequence
  chemically synthesized
gttcacaaaaatgttatgagca

SEQ ID NO: 1399007 - DNA, 22 bp, Artificial Sequence
  chemically synthesized
ctgggagcctctgctcataaca

SEQ ID NO: 1399008 - DNA, 22 bp, Artificial Sequence
  chemically synthesized
tgggagcctctgctcataacat

SEQ ID NO: 1399009 - DNA, 22 bp, Artificial Sequence
  chemically synthesized
ctggttcacaaaaatgttatga

SEQ ID NO: 1399010 - DNA, 22 bp, Artificial Sequence
  chemically synthesized
ggagcctctgctcataacattt

SEQ ID NO: 1399011 - DNA, 22 bp, Artificial Sequence
  chemically synthesized
tacattgctggttcacaaaaat

SEQ ID NO: 1399012 - DNA, 22 bp, Artificial Sequence
  chemically synthesized
tgctcataacatttttgtgaac

SEQ ID NO: 1399013 - DNA, 22 bp, Artificial Sequence
  chemically synthesized
ctcataacatttttgtgaacca

SEQ ID NO: 1399014 - DNA, 22 bp, Artificial Sequence
  chemically synthesized
ataacatttttgtgaaccagca

SEQ ID NO: 1399015 - DNA, 22 bp, Artificial Sequence
  chemically synthesized
ttgtgaaccagcaatgtataat

SEQ ID NO: 1399016 - DNA, 22 bp, Artificial Sequence
  chemically synthesized
tgtgaaccagcaatgtataatc

SEQ ID NO: 1399017 - DNA, 22 bp, Artificial Sequence
  chemically synthesized
gtgaaccagcaatgtataatcc

SEQ ID NO: 1399018 - DNA, 22 bp, Artificial Sequence
  chemically synthesized
tgaaccagcaatgtataatccc

SEQ ID NO: 1399019 - DNA, 22 bp, Artificial Sequence
  chemically synthesized
aacagaaaaacaggcaaaatgg

SEQ ID NO: 1399020 - DNA, 22 bp, Artificial Sequence
  chemically synthesized
aaacagaaaaacaggcaaaatg

SEQ ID NO: 1399021 - DNA, 22 bp, Artificial Sequence
  chemically synthesized
taaacagaaaaacaggcaaaat

SEQ ID NO: 1399022 - DNA, 22 bp, Artificial Sequence
  chemically synthesized
ttaaacagaaaaacaggcaaaa

SEQ ID NO: 1399023 - DNA, 22 bp, Artificial Sequence
  chemically synthesized
aataagatgtttttaaacagaa

SEQ ID NO: 1399024 - DNA, 22 bp, Artificial Sequence
  chemically synthesized
tgcctgtttttctgtttaaaaa

SEQ ID NO: 1399025 - DNA, 22 bp, Artificial Sequence
  chemically synthesized
gcctgtttttctgtttaaaaac

SEQ ID NO: 1399026 - DNA, 22 bp, Artificial Sequence
  chemically synthesized
cctgtttttctgtttaaaaaca

SEQ ID NO: 1399027 - DNA, 22 bp, Artificial Sequence
  chemically synthesized
tttttctgtttaaaaacatctt

SEQ ID NO: 1399028 - DNA, 22 bp, Artificial Sequence
  chemically synthesized
ttctgtttaaaaacatcttatt

SEQ ID NO: 1399029 - DNA, 22 bp, Artificial Sequence
  chemically synthesized
tctgtttaaaaacatcttattg

SEQ ID NO: 1399030 - DNA, 22 bp, Artificial Sequence
  chemically synthesized
ctgtttaaaaacatcttattga

SEQ ID NO: 1399031 - DNA, 22 bp, Artificial Sequence
  chemically synthesized
tgtttaaaaacatcttattgaa

SEQ ID NO: 1399032 - DNA, 22 bp, Artificial Sequence
  chemically synthesized
tttaaaaacatcttattgaata

SEQ ID NO: 1399033 - DNA, 22 bp, Artificial Sequence
  chemically synthesized
aaaaacatcttattgaatatat

SEQ ID NO: 1399034 - DNA, 22 bp, Artificial Sequence
  chemically synthesized
aaaacatcttattgaatatata

SEQ ID NO: 1399035 - DNA, 22 bp, Artificial Sequence
  chemically synthesized
atggatcaataatatatattca

SEQ ID NO: 1399036 - DNA, 22 bp, Artificial Sequence
  chemically synthesized
aatgttaatggatcaataatat

SEQ ID NO: 1399037 - DNA, 22 bp, Artificial Sequence
  chemically synthesized
attgaatatatattattgatcc

SEQ ID NO: 1399038 - DNA, 22 bp, Artificial Sequence
  chemically synthesized
ttgaatatatattattgatcca

SEQ ID NO: 1399039 - DNA, 22 bp, Artificial Sequence
  chemically synthesized
aatatatattattgatccatta

SEQ ID NO: 1399040 - DNA, 22 bp, Artificial Sequence
  chemically synthesized
tgtattgaatgttaatggatca

SEQ ID NO: 1399041 - DNA, 22 bp, Artificial Sequence
  chemically synthesized
gctgtgtattgaatgttaatgg

SEQ ID NO: 1399042 - DNA, 22 bp, Artificial Sequence
  chemically synthesized
ttggctgtgtattgaatgttaa

SEQ ID NO: 1399043 - DNA, 22 bp, Artificial Sequence
  chemically synthesized
ttgatccattaacattcaatac

SEQ ID NO: 1399044 - DNA, 22 bp, Artificial Sequence
  chemically synthesized
atccattaacattcaatacaca

SEQ ID NO: 1399045 - DNA, 22 bp, Artificial Sequence
  chemically synthesized
cagtgctgttggctgtgtattg

SEQ ID NO: 1399046 - DNA, 22 bp, Artificial Sequence
  chemically synthesized
agttacagtgctgttggctgtg

SEQ ID NO: 1399047 - DNA, 22 bp, Artificial Sequence
  chemically synthesized
gagttacagtgctgttggctgt

SEQ ID NO: 1399048 - DNA, 22 bp, Artificial Sequence
  chemically synthesized
acattcaatacacagccaacag

SEQ ID NO: 1399049 - DNA, 22 bp, Artificial Sequence
  chemically synthesized
aggcttgagttacagtgctgtt

SEQ ID NO: 1399050 - DNA, 22 bp, Artificial Sequence
  chemically synthesized
aatacacagccaacagcactgt

SEQ ID NO: 1399051 - DNA, 22 bp, Artificial Sequence
  chemically synthesized
caggcttgagttacagtgctgt

SEQ ID NO: 1399052 - DNA, 22 bp, Artificial Sequence
  chemically synthesized
cttcaggcttgagttacagtgc

SEQ ID NO: 1399053 - DNA, 22 bp, Artificial Sequence
  chemically synthesized
ccttcaggcttgagttacagtg

SEQ ID NO: 1399054 - DNA, 22 bp, Artificial Sequence
  chemically synthesized
ggtaagtttccttcaggcttga

SEQ ID NO: 1399055 - DNA, 22 bp, Artificial Sequence
  chemically synthesized
aggtaagtttccttcaggcttg

SEQ ID NO: 1399056 - DNA, 22 bp, Artificial Sequence
  chemically synthesized
cttaggtaagtttccttcaggc

SEQ ID NO: 1399057 - DNA, 22 bp, Artificial Sequence
  chemically synthesized
taactcaagcctgaaggaaact

SEQ ID NO: 1399058 - DNA, 22 bp, Artificial Sequence
  chemically synthesized
aagcctgaaggaaacttaccta

SEQ ID NO: 1399059 - DNA, 22 bp, Artificial Sequence
  chemically synthesized
gaaagaaaataggttccttagg

SEQ ID NO: 1399060 - DNA, 22 bp, Artificial Sequence
  chemically synthesized
aaggaaacttacctaaggaacc

SEQ ID NO: 1399061 - DNA, 22 bp, Artificial Sequence
  chemically synthesized
agaaagaaaataggttccttag

SEQ ID NO: 1399062 - DNA, 22 bp, Artificial Sequence
  chemically synthesized
acctaaggaacctattttcttt

SEQ ID NO: 1399063 - DNA, 22 bp, Artificial Sequence
  chemically synthesized
cctaaggaacctattttctttc

SEQ ID NO: 1399064 - DNA, 22 bp, Artificial Sequence
  chemically synthesized
tgaagtaccttagaaagaaaat

SEQ ID NO: 1399065 - DNA, 22 bp, Artificial Sequence
  chemically synthesized
aggaacctattttctttctaag

SEQ ID NO: 1399066 - DNA, 22 bp, Artificial Sequence
  chemically synthesized
agaaggctgtgaagtaccttag

SEQ ID NO: 1399067 - DNA, 22 bp, Artificial Sequence
  chemically synthesized
aagaaggctgtgaagtacctta

SEQ ID NO: 1399068 - DNA, 22 bp, Artificial Sequence
  chemically synthesized
ttttctttctaaggtacttcac

SEQ ID NO: 1399069 - DNA, 22 bp, Artificial Sequence
  chemically synthesized
agcttaagaaggctgtgaagta

SEQ ID NO: 1399070 - DNA, 22 bp, Artificial Sequence
  chemically synthesized
tctttctaaggtacttcacagc

SEQ ID NO: 1399071 - DNA, 22 bp, Artificial Sequence
  chemically synthesized
ctttctaaggtacttcacagcc

SEQ ID NO: 1399072 - DNA, 22 bp, Artificial Sequence
  chemically synthesized
tttctaaggtacttcacagcct

SEQ ID NO: 1399073 - DNA, 22 bp, Artificial Sequence
  chemically synthesized
ctaagcttaagaaggctgtgaa

SEQ ID NO: 1399074 - DNA, 22 bp, Artificial Sequence
  chemically synthesized
tctaaggtacttcacagccttc

SEQ ID NO: 1399075 - DNA, 22 bp, Artificial Sequence
  chemically synthesized
ctaaggtacttcacagccttct

SEQ ID NO: 1399076 - DNA, 22 bp, Artificial Sequence
  chemically synthesized
taaggtacttcacagccttctt

SEQ ID NO: 1399077 - DNA, 22 bp, Artificial Sequence
  chemically synthesized
aggtacttcacagccttcttaa

SEQ ID NO: 1399078 - DNA, 22 bp, Artificial Sequence
  chemically synthesized
gtgttcctaagcttaagaaggc

SEQ ID NO: 1399079 - DNA, 22 bp, Artificial Sequence
  chemically synthesized
tctagtgttcctaagcttaaga

SEQ ID NO: 1399080 - DNA, 22 bp, Artificial Sequence
  chemically synthesized
tgtctagtgttcctaagcttaa

SEQ ID NO: 1399081 - DNA, 22 bp, Artificial Sequence
  chemically synthesized
ctgtctagtgttcctaagctta

SEQ ID NO: 1399082 - DNA, 22 bp, Artificial Sequence
  chemically synthesized
cacagccttcttaagcttagga

SEQ ID NO: 1399083 - DNA, 22 bp, Artificial Sequence
  chemically synthesized
acagccttcttaagcttaggaa

SEQ ID NO: 1399084 - DNA, 22 bp, Artificial Sequence
  chemically synthesized
cttaagcttaggaacactagac

SEQ ID NO: 1399085 - DNA, 22 bp, Artificial Sequence
  chemically synthesized
ttaagcttaggaacactagaca

SEQ ID NO: 1399086 - DNA, 22 bp, Artificial Sequence
  chemically synthesized
aagcttaggaacactagacaga

SEQ ID NO: 1399087 - DNA, 22 bp, Artificial Sequence
  chemically synthesized
agcttaggaacactagacagaa

SEQ ID NO: 1399088 - DNA, 22 bp, Artificial Sequence
  chemically synthesized
aggaacactagacagaaattca

SEQ ID NO: 1399089 - DNA, 22 bp, Artificial Sequence
  chemically synthesized
ggaacactagacagaaattcac

SEQ ID NO: 1399090 - DNA, 22 bp, Artificial Sequence
  chemically synthesized
aatggccccaagcatgatggtg

SEQ ID NO: 1399091 - DNA, 22 bp, Artificial Sequence
  chemically synthesized
aaatggccccaagcatgatggt

SEQ ID NO: 1399092 - DNA, 22 bp, Artificial Sequence
  chemically synthesized
gacagaaattcaccatcatgct

SEQ ID NO: 1399093 - DNA, 22 bp, Artificial Sequence
  chemically synthesized
taaatggccccaagcatgatgg

SEQ ID NO: 1399094 - DNA, 22 bp, Artificial Sequence
  chemically synthesized
ctttaaatggccccaagcatga

SEQ ID NO: 1399095 - DNA, 22 bp, Artificial Sequence
  chemically synthesized
ctgctttaaatggccccaagca

SEQ ID NO: 1399096 - DNA, 22 bp, Artificial Sequence
  chemically synthesized
gctgctttaaatggccccaagc

SEQ ID NO: 1399097 - DNA, 22 bp, Artificial Sequence
  chemically synthesized
tgctgctttaaatggccccaag

SEQ ID NO: 1399098 - DNA, 22 bp, Artificial Sequence
  chemically synthesized
accatcatgcttggggccattt

SEQ ID NO: 1399099 - DNA, 22 bp, Artificial Sequence
  chemically synthesized
gtgattttgctgctttaaatgg

SEQ ID NO: 1399100 - DNA, 22 bp, Artificial Sequence
  chemically synthesized
ggtgattttgctgctttaaatg

SEQ ID NO: 1399101 - DNA, 22 bp, Artificial Sequence
  chemically synthesized
ttggtgattttgctgctttaaa

SEQ ID NO: 1399102 - DNA, 22 bp, Artificial Sequence
  chemically synthesized
cttggtgattttgctgctttaa

SEQ ID NO: 1399103 - DNA, 22 bp, Artificial Sequence
  chemically synthesized
tcttggtgattttgctgcttta

SEQ ID NO: 1399104 - DNA, 22 bp, Artificial Sequence
  chemically synthesized
ttcttggtgattttgctgcttt

SEQ ID NO: 1399105 - DNA, 22 bp, Artificial Sequence
  chemically synthesized
tttcttggtgattttgctgctt

SEQ ID NO: 1399106 - DNA, 22 bp, Artificial Sequence
  chemically synthesized
ggggccatttaaagcagcaaaa

SEQ ID NO: 1399107 - DNA, 22 bp, Artificial Sequence
  chemically synthesized
gggccatttaaagcagcaaaat

SEQ ID NO: 1399108 - DNA, 22 bp, Artificial Sequence
  chemically synthesized
tgctttttcttggtgattttgc

SEQ ID NO: 1399109 - DNA, 22 bp, Artificial Sequence
  chemically synthesized
atgctttttcttggtgattttg

SEQ ID NO: 1399110 - DNA, 22 bp, Artificial Sequence
  chemically synthesized
tatgctttttcttggtgatttt

SEQ ID NO: 1399111 - DNA, 22 bp, Artificial Sequence
  chemically synthesized
ttatgctttttcttggtgattt

SEQ ID NO: 1399112 - DNA, 22 bp, Artificial Sequence
  chemically synthesized
aaagcagcaaaatcaccaagaa

SEQ ID NO: 1399113 - DNA, 22 bp, Artificial Sequence
  chemically synthesized
aagcagcaaaatcaccaagaaa

SEQ ID NO: 1399114 - DNA, 22 bp, Artificial Sequence
  chemically synthesized
atatttttatgctttttcttgg

SEQ ID NO: 1399115 - DNA, 22 bp, Artificial Sequence
  chemically synthesized
catatttttatgctttttcttg

SEQ ID NO: 1399116 - DNA, 22 bp, Artificial Sequence
  chemically synthesized
tcatatttttatgctttttctt

SEQ ID NO: 1399117 - DNA, 22 bp, Artificial Sequence
  chemically synthesized
ttcatatttttatgctttttct

SEQ ID NO: 1399118 - DNA, 22 bp, Artificial Sequence
  chemically synthesized
tgtttttcatatttttatgctt

SEQ ID NO: 1399119 - DNA, 22 bp, Artificial Sequence
  chemically synthesized
atgctatgtttttcatattttt

SEQ ID NO: 1399120 - DNA, 22 bp, Artificial Sequence
  chemically synthesized
aatgctatgtttttcatatttt

SEQ ID NO: 1399121 - DNA, 22 bp, Artificial Sequence
  chemically synthesized
agcggtgtatttaatgctatgt

SEQ ID NO: 1399122 - DNA, 22 bp, Artificial Sequence
  chemically synthesized
cagcggtgtatttaatgctatg

SEQ ID NO: 1399123 - DNA, 22 bp, Artificial Sequence
  chemically synthesized
tcagcggtgtatttaatgctat

SEQ ID NO: 1399124 - DNA, 22 bp, Artificial Sequence
  chemically synthesized
aatacaccgctgaaaggacact

SEQ ID NO: 1399125 - DNA, 22 bp, Artificial Sequence
  chemically synthesized
atacggtaaacaagtgtccttt

SEQ ID NO: 1399126 - DNA, 22 bp, Artificial Sequence
  chemically synthesized
aggtctcatacggtaaacaagt

SEQ ID NO: 1399127 - DNA, 22 bp, Artificial Sequence
  chemically synthesized
caggtctcatacggtaaacaag

SEQ ID NO: 1399128 - DNA, 22 bp, Artificial Sequence
  chemically synthesized
cttcaggtctcatacggtaaac

SEQ ID NO: 1399129 - DNA, 22 bp, Artificial Sequence
  chemically synthesized
aaaggacacttgtttaccgtat

SEQ ID NO: 1399130 - DNA, 22 bp, Artificial Sequence
  chemically synthesized
gcttcaggtctcatacggtaaa

SEQ ID NO: 1399131 - DNA, 22 bp, Artificial Sequence
  chemically synthesized
ttgcttcaggtctcatacggta

SEQ ID NO: 1399132 - DNA, 22 bp, Artificial Sequence
  chemically synthesized
cattcttgcttcaggtctcata

SEQ ID NO: 1399133 - DNA, 22 bp, Artificial Sequence
  chemically synthesized
tgcattcttgcttcaggtctca

SEQ ID NO: 1399134 - DNA, 22 bp, Artificial Sequence
  chemically synthesized
gtttaccgtatgagacctgaag

SEQ ID NO: 1399135 - DNA, 22 bp, Artificial Sequence
  chemically synthesized
tttaccgtatgagacctgaagc

SEQ ID NO: 1399136 - DNA, 22 bp, Artificial Sequence
  chemically synthesized
accgtatgagacctgaagcaag

SEQ ID NO: 1399137 - DNA, 22 bp, Artificial Sequence
  chemically synthesized
ccgtatgagacctgaagcaaga

SEQ ID NO: 1399138 - DNA, 22 bp, Artificial Sequence
  chemically synthesized
agatcaaaaaaggaacactctg

SEQ ID NO: 1399139 - DNA, 22 bp, Artificial Sequence
  chemically synthesized
aagcaagaatgcagagtgttcc

SEQ ID NO: 1399140 - DNA, 22 bp, Artificial Sequence
  chemically synthesized
ccagctgagatcaaaaaaggaa

SEQ ID NO: 1399141 - DNA, 22 bp, Artificial Sequence
  chemically synthesized
cttttttgatctcagctgggaa

SEQ ID NO: 1399142 - DNA, 22 bp, Artificial Sequence
  chemically synthesized
ttttgatctcagctgggaacat

SEQ ID NO: 1399143 - DNA, 22 bp, Artificial Sequence
  chemically synthesized
tttgatctcagctgggaacatg

SEQ ID NO: 1399144 - DNA, 22 bp, Artificial Sequence
  chemically synthesized
ttgatctcagctgggaacatgt

SEQ ID NO: 1399145 - DNA, 22 bp, Artificial Sequence
  chemically synthesized
tgatctcagctgggaacatgtg

SEQ ID NO: 1399146 - DNA, 22 bp, Artificial Sequence
  chemically synthesized
agtcacccaccacacatgttcc

SEQ ID NO: 1399147 - DNA, 22 bp, Artificial Sequence
  chemically synthesized
gatctcagctgggaacatgtgt

SEQ ID NO: 1399148 - DNA, 22 bp, Artificial Sequence
  chemically synthesized
aagtcacccaccacacatgttc

SEQ ID NO: 1399149 - DNA, 22 bp, Artificial Sequence
  chemically synthesized
atctcagctgggaacatgtgtg

SEQ ID NO: 1399150 - DNA, 22 bp, Artificial Sequence
  chemically synthesized
agctgggaacatgtgtggtggg

SEQ ID NO: 1399151 - DNA, 22 bp, Artificial Sequence
  chemically synthesized
ggaacatgtgtggtgggtgact

SEQ ID NO: 1399152 - DNA, 22 bp, Artificial Sequence
  chemically synthesized
tgtgtatgcatagagtggtgaa

SEQ ID NO: 1399153 - DNA, 22 bp, Artificial Sequence
  chemically synthesized
gtgtgtatgcatagagtggtga

SEQ ID NO: 1399154 - DNA, 22 bp, Artificial Sequence
  chemically synthesized
aaatttttcaccactctatgca

SEQ ID NO: 1399155 - DNA, 22 bp, Artificial Sequence
  chemically synthesized
aatttttcaccactctatgcat

SEQ ID NO: 1399156 - DNA, 22 bp, Artificial Sequence
  chemically synthesized
acagccatttgtgtgtatgcat

SEQ ID NO: 1399157 - DNA, 22 bp, Artificial Sequence
  chemically synthesized
ttcaccactctatgcatacaca

SEQ ID NO: 1399158 - DNA, 22 bp, Artificial Sequence
  chemically synthesized
cacagccatttgtgtgtatgca

SEQ ID NO: 1399159 - DNA, 22 bp, Artificial Sequence
  chemically synthesized
tcaccactctatgcatacacac

SEQ ID NO: 1399160 - DNA, 22 bp, Artificial Sequence
  chemically synthesized
tcacagccatttgtgtgtatgc

SEQ ID NO: 1399161 - DNA, 22 bp, Artificial Sequence
  chemically synthesized
caccactctatgcatacacaca

SEQ ID NO: 1399162 - DNA, 22 bp, Artificial Sequence
  chemically synthesized
accactctatgcatacacacaa

SEQ ID NO: 1399163 - DNA, 22 bp, Artificial Sequence
  chemically synthesized
tatgcatacacacaaatggctg

SEQ ID NO: 1399164 - DNA, 22 bp, Artificial Sequence
  chemically synthesized
atagcattttcacagccatttg

SEQ ID NO: 1399165 - DNA, 22 bp, Artificial Sequence
  chemically synthesized
tgcatacacacaaatggctgtg

SEQ ID NO: 1399166 - DNA, 22 bp, Artificial Sequence
  chemically synthesized
aaatcaatgctcatagcatttt

SEQ ID NO: 1399167 - DNA, 22 bp, Artificial Sequence
  chemically synthesized
tatccctaaaatcaatgctcat

SEQ ID NO: 1399168 - DNA, 22 bp, Artificial Sequence
  chemically synthesized
gtatccctaaaatcaatgctca

SEQ ID NO: 1399169 - DNA, 22 bp, Artificial Sequence
  chemically synthesized
tgaaaatgctatgagcattgat

SEQ ID NO: 1399170 - DNA, 22 bp, Artificial Sequence
  chemically synthesized
atttgtatccctaaaatcaatg

SEQ ID NO: 1399171 - DNA, 22 bp, Artificial Sequence
  chemically synthesized
aatttgtatccctaaaatcaat

SEQ ID NO: 1399172 - DNA, 22 bp, Artificial Sequence
  chemically synthesized
aatttaatttgtatccctaaaa

SEQ ID NO: 1399173 - DNA, 22 bp, Artificial Sequence
  chemically synthesized
tgagcattgattttagggatac

SEQ ID NO: 1399174 - DNA, 22 bp, Artificial Sequence
  chemically synthesized
ctaaatttaatttgtatcccta

SEQ ID NO: 1399175 - DNA, 22 bp, Artificial Sequence
  chemically synthesized
gctaaatttaatttgtatccct

SEQ ID NO: 1399176 - DNA, 22 bp, Artificial Sequence
  chemically synthesized
attttagggatacaaattaaat

SEQ ID NO: 1399177 - DNA, 22 bp, Artificial Sequence
  chemically synthesized
aaaacttgctaaatttaatttg

SEQ ID NO: 1399178 - DNA, 22 bp, Artificial Sequence
  chemically synthesized
tcaaaacttgctaaatttaatt

SEQ ID NO: 1399179 - DNA, 22 bp, Artificial Sequence
  chemically synthesized
tagggatacaaattaaatttag

SEQ ID NO: 1399180 - DNA, 22 bp, Artificial Sequence
  chemically synthesized
agggatacaaattaaatttagc

SEQ ID NO: 1399181 - DNA, 22 bp, Artificial Sequence
  chemically synthesized
gggatacaaattaaatttagca

SEQ ID NO: 1399182 - DNA, 22 bp, Artificial Sequence
  chemically synthesized
ggagttctcaaaacttgctaaa

SEQ ID NO: 1399183 - DNA, 22 bp, Artificial Sequence
  chemically synthesized
gggagttctcaaaacttgctaa

SEQ ID NO: 1399184 - DNA, 22 bp, Artificial Sequence
  chemically synthesized
tgtttgggagttctcaaaactt

SEQ ID NO: 1399185 - DNA, 22 bp, Artificial Sequence
  chemically synthesized
tgtgtttgggagttctcaaaac

SEQ ID NO: 1399186 - DNA, 22 bp, Artificial Sequence
  chemically synthesized
aatttagcaagttttgagaact

SEQ ID NO: 1399187 - DNA, 22 bp, Artificial Sequence
  chemically synthesized
agcaagttttgagaactcccaa

SEQ ID NO: 1399188 - DNA, 22 bp, Artificial Sequence
  chemically synthesized
gcaagttttgagaactcccaaa

SEQ ID NO: 1399189 - DNA, 22 bp, Artificial Sequence
  chemically synthesized
acacattctgtgtttgggagtt

SEQ ID NO: 1399190 - DNA, 22 bp, Artificial Sequence
  chemically synthesized
ttcacacattctgtgtttggga

SEQ ID NO: 1399191 - DNA, 22 bp, Artificial Sequence
  chemically synthesized
attattcacacattctgtgttt

SEQ ID NO: 1399192 - DNA, 22 bp, Artificial Sequence
  chemically synthesized
tgagaactcccaaacacagaat

SEQ ID NO: 1399193 - DNA, 22 bp, Artificial Sequence
  chemically synthesized
gagaactcccaaacacagaatg

SEQ ID NO: 1399194 - DNA, 22 bp, Artificial Sequence
  chemically synthesized
tcattattcacacattctgtgt

SEQ ID NO: 1399195 - DNA, 22 bp, Artificial Sequence
  chemically synthesized
agaactcccaaacacagaatgt

SEQ ID NO: 1399196 - DNA, 22 bp, Artificial Sequence
  chemically synthesized
ccaaacacagaatgtgtgaata

SEQ ID NO: 1399197 - DNA, 22 bp, Artificial Sequence
  chemically synthesized
tacagatggttctcattattca

SEQ ID NO: 1399198 - DNA, 22 bp, Artificial Sequence
  chemically synthesized
gtacagatggttctcattattc

SEQ ID NO: 1399199 - DNA, 22 bp, Artificial Sequence
  chemically synthesized
tgtacagatggttctcattatt

SEQ ID NO: 1399200 - DNA, 22 bp, Artificial Sequence
  chemically synthesized
aaactttgtacagatggttctc

SEQ ID NO: 1399201 - DNA, 22 bp, Artificial Sequence
  chemically synthesized
attgaaactttgtacagatggt

SEQ ID NO: 1399202 - DNA, 22 bp, Artificial Sequence
  chemically synthesized
atcaagcagtatattgattgaa

SEQ ID NO: 1399203 - DNA, 22 bp, Artificial Sequence
  chemically synthesized
tacaaagtttcaatcaatatac

SEQ ID NO: 1399204 - DNA, 22 bp, Artificial Sequence
  chemically synthesized
taaaaagggcctaatcaagcag

SEQ ID NO: 1399205 - DNA, 22 bp, Artificial Sequence
  chemically synthesized
caatcaatatactgcttgatta

SEQ ID NO: 1399206 - DNA, 22 bp, Artificial Sequence
  chemically synthesized
ataaaaagggcctaatcaagca

SEQ ID NO: 1399207 - DNA, 22 bp, Artificial Sequence
  chemically synthesized
aatcaatatactgcttgattag

SEQ ID NO: 1399208 - DNA, 22 bp, Artificial Sequence
  chemically synthesized
tataaaaagggcctaatcaagc

SEQ ID NO: 1399209 - DNA, 22 bp, Artificial Sequence
  chemically synthesized
cttgattaggccctttttataa

SEQ ID NO: 1399210 - DNA, 22 bp, Artificial Sequence
  chemically synthesized
gattaggccctttttataaagc

SEQ ID NO: 1399211 - DNA, 22 bp, Artificial Sequence
  chemically synthesized
attaggccctttttataaagca

SEQ ID NO: 1399212 - DNA, 22 bp, Artificial Sequence
  chemically synthesized
aaaacagtatagtgctttataa

SEQ ID NO: 1399213 - DNA, 22 bp, Artificial Sequence
  chemically synthesized
ggccctttttataaagcactat

SEQ ID NO: 1399214 - DNA, 22 bp, Artificial Sequence
  chemically synthesized
caactaaaaacagtatagtgct

SEQ ID NO: 1399215 - DNA, 22 bp, Artificial Sequence
  chemically synthesized
gcaactaaaaacagtatagtgc

SEQ ID NO: 1399216 - DNA, 22 bp, Artificial Sequence
  chemically synthesized
tttataaagcactatactgttt

SEQ ID NO: 1399217 - DNA, 22 bp, Artificial Sequence
  chemically synthesized
ttataaagcactatactgtttt

SEQ ID NO: 1399218 - DNA, 22 bp, Artificial Sequence
  chemically synthesized
tataaagcactatactgttttt

SEQ ID NO: 1399219 - DNA, 22 bp, Artificial Sequence
  chemically synthesized
ataaagcactatactgttttta

SEQ ID NO: 1399220 - DNA, 22 bp, Artificial Sequence
  chemically synthesized
accatttgcaactaaaaacagt

SEQ ID NO: 1399221 - DNA, 22 bp, Artificial Sequence
  chemically synthesized
taaagcactatactgtttttag

SEQ ID NO: 1399222 - DNA, 22 bp, Artificial Sequence
  chemically synthesized
aaccatttgcaactaaaaacag

SEQ ID NO: 1399223 - DNA, 22 bp, Artificial Sequence
  chemically synthesized
tactgtttttagttgcaaatgg

SEQ ID NO: 1399224 - DNA, 22 bp, Artificial Sequence
  chemically synthesized
tttttagttgcaaatggttaaa

SEQ ID NO: 1399225 - DNA, 22 bp, Artificial Sequence
  chemically synthesized
ttagttgcaaatggttaaatcc

SEQ ID NO: 1399226 - DNA, 22 bp, Artificial Sequence
  chemically synthesized
tagttgcaaatggttaaatcct

SEQ ID NO: 1399227 - DNA, 22 bp, Artificial Sequence
  chemically synthesized
agttgcaaatggttaaatcctt

SEQ ID NO: 1399228 - DNA, 22 bp, Artificial Sequence
  chemically synthesized
gttgcaaatggttaaatccttt

SEQ ID NO: 1399229 - DNA, 22 bp, Artificial Sequence
  chemically synthesized
caaatggttaaatcctttcatc

SEQ ID NO: 1399230 - DNA, 22 bp, Artificial Sequence
  chemically synthesized
aatcctttcatcccatttggtt

SEQ ID NO: 1399231 - DNA, 22 bp, Artificial Sequence
  chemically synthesized
tacaaacaccataaccaaatgg

SEQ ID NO: 1399232 - DNA, 22 bp, Artificial Sequence
  chemically synthesized
tgtacaaacaccataaccaaat

SEQ ID NO: 1399233 - DNA, 22 bp, Artificial Sequence
  chemically synthesized
ctgtacaaacaccataaccaaa

SEQ ID NO: 1399234 - DNA, 22 bp, Artificial Sequence
  chemically synthesized
tctgtacaaacaccataaccaa

SEQ ID NO: 1399235 - DNA, 22 bp, Artificial Sequence
  chemically synthesized
tcatcccatttggttatggtgt

SEQ ID NO: 1399236 - DNA, 22 bp, Artificial Sequence
  chemically synthesized
catcccatttggttatggtgtt

SEQ ID NO: 1399237 - DNA, 22 bp, Artificial Sequence
  chemically synthesized
gttttctgtacaaacaccataa

SEQ ID NO: 1399238 - DNA, 22 bp, Artificial Sequence
  chemically synthesized
atcccatttggttatggtgttt

SEQ ID NO: 1399239 - DNA, 22 bp, Artificial Sequence
  chemically synthesized
agttttctgtacaaacaccata

SEQ ID NO: 1399240 - DNA, 22 bp, Artificial Sequence
  chemically synthesized
taatttagttttctgtacaaac

SEQ ID NO: 1399241 - DNA, 22 bp, Artificial Sequence
  chemically synthesized
ggttatggtgtttgtacagaaa

SEQ ID NO: 1399242 - DNA, 22 bp, Artificial Sequence
  chemically synthesized
gttatggtgtttgtacagaaaa

SEQ ID NO: 1399243 - DNA, 22 bp, Artificial Sequence
  chemically synthesized
tggtgtttgtacagaaaactaa

SEQ ID NO: 1399244 - DNA, 22 bp, Artificial Sequence
  chemically synthesized
gtacagaaaactaaattacaga

SEQ ID NO: 1399245 - DNA, 22 bp, Artificial Sequence
  chemically synthesized
tacagaaaactaaattacagac

SEQ ID NO: 1399246 - DNA, 22 bp, Artificial Sequence
  chemically synthesized
gagaaagtcaacaatacacatg

SEQ ID NO: 1399247 - DNA, 22 bp, Artificial Sequence
  chemically synthesized
aattacagacatgtgtattgtt

SEQ ID NO: 1399248 - DNA, 22 bp, Artificial Sequence
  chemically synthesized
cagacatgtgtattgttgactt

SEQ ID NO: 1399249 - DNA, 22 bp, Artificial Sequence
  chemically synthesized
aaaagggcaattagagaaagtc

SEQ ID NO: 1399250 - DNA, 22 bp, Artificial Sequence
  chemically synthesized
agatcattcaaaagggcaatta

SEQ ID NO: 1399251 - DNA, 22 bp, Artificial Sequence
  chemically synthesized
ttgactttctctaattgccctt

SEQ ID NO: 1399252 - DNA, 22 bp, Artificial Sequence
  chemically synthesized
ctcagatcattcaaaagggcaa

SEQ ID NO: 1399253 - DNA, 22 bp, Artificial Sequence
  chemically synthesized
actttctctaattgcccttttg

SEQ ID NO: 1399254 - DNA, 22 bp, Artificial Sequence
  chemically synthesized
tgctcagatcattcaaaagggc

SEQ ID NO: 1399255 - DNA, 22 bp, Artificial Sequence
  chemically synthesized
tctctaattgcccttttgaatg

SEQ ID NO: 1399256 - DNA, 22 bp, Artificial Sequence
  chemically synthesized
ctctaattgcccttttgaatga

SEQ ID NO: 1399257 - DNA, 22 bp, Artificial Sequence
  chemically synthesized
tctaattgcccttttgaatgat

SEQ ID NO: 1399258 - DNA, 22 bp, Artificial Sequence
  chemically synthesized
atctctgctcagatcattcaaa

SEQ ID NO: 1399259 - DNA, 22 bp, Artificial Sequence
  chemically synthesized
taattgcccttttgaatgatct

SEQ ID NO: 1399260 - DNA, 22 bp, Artificial Sequence
  chemically synthesized
attgcccttttgaatgatctga

SEQ ID NO: 1399261 - DNA, 22 bp, Artificial Sequence
  chemically synthesized
cccttttgaatgatctgagcag

SEQ ID NO: 1399262 - DNA, 22 bp, Artificial Sequence
  chemically synthesized
gtccagcagttgatctctgctc

SEQ ID NO: 1399263 - DNA, 22 bp, Artificial Sequence
  chemically synthesized
ttgaatgatctgagcagagatc

SEQ ID NO: 1399264 - DNA, 22 bp, Artificial Sequence
  chemically synthesized
ggtccagcagttgatctctgct

SEQ ID NO: 1399265 - DNA, 22 bp, Artificial Sequence
  chemically synthesized
tgaatgatctgagcagagatca

SEQ ID NO: 1399266 - DNA, 22 bp, Artificial Sequence
  chemically synthesized
gaatgatctgagcagagatcaa

SEQ ID NO: 1399267 - DNA, 22 bp, Artificial Sequence
  chemically synthesized
aatgatctgagcagagatcaac

SEQ ID NO: 1399268 - DNA, 22 bp, Artificial Sequence
  chemically synthesized
agcagagatcaactgctggacc

SEQ ID NO: 1399269 - DNA, 22 bp, Artificial Sequence
  chemically synthesized
gacgtacaatttggtccagcag

SEQ ID NO: 1399270 - DNA, 22 bp, Artificial Sequence
  chemically synthesized
taatctcgacgtacaatttggt

SEQ ID NO: 1399271 - DNA, 22 bp, Artificial Sequence
  chemically synthesized
gatattataatctcgacgtaca

SEQ ID NO: 1399272 - DNA, 22 bp, Artificial Sequence
  chemically synthesized
ctggaccaaattgtacgtcgag

SEQ ID NO: 1399273 - DNA, 22 bp, Artificial Sequence
  chemically synthesized
gaccaaattgtacgtcgagatt

SEQ ID NO: 1399274 - DNA, 22 bp, Artificial Sequence
  chemically synthesized
acaaaacctggatattataatc

SEQ ID NO: 1399275 - DNA, 22 bp, Artificial Sequence
  chemically synthesized
tacgtcgagattataatatcca

SEQ ID NO: 1399276 - DNA, 22 bp, Artificial Sequence
  chemically synthesized
accatagtgcctgacaaaacct

SEQ ID NO: 1399277 - DNA, 22 bp, Artificial Sequence
  chemically synthesized
aaccatagtgcctgacaaaacc

SEQ ID NO: 1399278 - DNA, 22 bp, Artificial Sequence
  chemically synthesized
ttaaccatagtgcctgacaaaa

SEQ ID NO: 1399279 - DNA, 22 bp, Artificial Sequence
  chemically synthesized
taatatccaggttttgtcaggc

SEQ ID NO: 1399280 - DNA, 22 bp, Artificial Sequence
  chemically synthesized
cttaaccatagtgcctgacaaa

SEQ ID NO: 1399281 - DNA, 22 bp, Artificial Sequence
  chemically synthesized
acaatacttcttaaccatagtg

SEQ ID NO: 1399282 - DNA, 22 bp, Artificial Sequence
  chemically synthesized
actgacaatacttcttaaccat

SEQ ID NO: 1399283 - DNA, 22 bp, Artificial Sequence
  chemically synthesized
tgtcaggcactatggttaagaa

SEQ ID NO: 1399284 - DNA, 22 bp, Artificial Sequence
  chemically synthesized
aactgacaatacttcttaacca

SEQ ID NO: 1399285 - DNA, 22 bp, Artificial Sequence
  chemically synthesized
gtcaggcactatggttaagaag

SEQ ID NO: 1399286 - DNA, 22 bp, Artificial Sequence
  chemically synthesized
tcaggcactatggttaagaagt

SEQ ID NO: 1399287 - DNA, 22 bp, Artificial Sequence
  chemically synthesized
cagtacatcttaactgacaata

SEQ ID NO: 1399288 - DNA, 22 bp, Artificial Sequence
  chemically synthesized
tggttaagaagtattgtcagtt

SEQ ID NO: 1399289 - DNA, 22 bp, Artificial Sequence
  chemically synthesized
aaattgcagtacatcttaactg

SEQ ID NO: 1399290 - DNA, 22 bp, Artificial Sequence
  chemically synthesized
agaagtattgtcagttaagatg

SEQ ID NO: 1399291 - DNA, 22 bp, Artificial Sequence
  chemically synthesized
aaaattgcagtacatcttaact

SEQ ID NO: 1399292 - DNA, 22 bp, Artificial Sequence
  chemically synthesized
cttaaaattgcagtacatctta

SEQ ID NO: 1399293 - DNA, 22 bp, Artificial Sequence
  chemically synthesized
gcttaaaattgcagtacatctt

SEQ ID NO: 1399294 - DNA, 22 bp, Artificial Sequence
  chemically synthesized
tgcttaaaattgcagtacatct

SEQ ID NO: 1399295 - DNA, 22 bp, Artificial Sequence
  chemically synthesized
ttgcttaaaattgcagtacatc

SEQ ID NO: 1399296 - DNA, 22 bp, Artificial Sequence
  chemically synthesized
tcagttaagatgtactgcaatt

SEQ ID NO: 1399297 - DNA, 22 bp, Artificial Sequence
  chemically synthesized
agatgtactgcaattttaagca

SEQ ID NO: 1399298 - DNA, 22 bp, Artificial Sequence
  chemically synthesized
agcatgtaaaaaaatcttttgc

SEQ ID NO: 1399299 - DNA, 22 bp, Artificial Sequence
  chemically synthesized
caattttaagcaaaagattttt

SEQ ID NO: 1399300 - DNA, 22 bp, Artificial Sequence
  chemically synthesized
gtagattgagcatgtaaaaaaa

SEQ ID NO: 1399301 - DNA, 22 bp, Artificial Sequence
  chemically synthesized
taagcaaaagatttttttacat

SEQ ID NO: 1399302 - DNA, 22 bp, Artificial Sequence
  chemically synthesized
agtagattgagcatgtaaaaaa

SEQ ID NO: 1399303 - DNA, 22 bp, Artificial Sequence
  chemically synthesized
aagcaaaagatttttttacatg

SEQ ID NO: 1399304 - DNA, 22 bp, Artificial Sequence
  chemically synthesized
agcaaaagatttttttacatgc

SEQ ID NO: 1399305 - DNA, 22 bp, Artificial Sequence
  chemically synthesized
cttagtagattgagcatgtaaa

SEQ ID NO: 1399306 - DNA, 22 bp, Artificial Sequence
  chemically synthesized
gttacttagtagattgagcatg

SEQ ID NO: 1399307 - DNA, 22 bp, Artificial Sequence
  chemically synthesized
ctggttacttagtagattgagc

SEQ ID NO: 1399308 - DNA, 22 bp, Artificial Sequence
  chemically synthesized
tcctggttacttagtagattga

SEQ ID NO: 1399309 - DNA, 22 bp, Artificial Sequence
  chemically synthesized
ctcctggttacttagtagattg

SEQ ID NO: 1399310 - DNA, 22 bp, Artificial Sequence
  chemically synthesized
ttttacatgctcaatctactaa

SEQ ID NO: 1399311 - DNA, 22 bp, Artificial Sequence
  chemically synthesized
tttacatgctcaatctactaag

SEQ ID NO: 1399312 - DNA, 22 bp, Artificial Sequence
  chemically synthesized
ttacatgctcaatctactaagt

SEQ ID NO: 1399313 - DNA, 22 bp, Artificial Sequence
  chemically synthesized
tacatgctcaatctactaagta

SEQ ID NO: 1399314 - DNA, 22 bp, Artificial Sequence
  chemically synthesized
tcttctcctggttacttagtag

SEQ ID NO: 1399315 - DNA, 22 bp, Artificial Sequence
  chemically synthesized
acatgctcaatctactaagtaa

SEQ ID NO: 1399316 - DNA, 22 bp, Artificial Sequence
  chemically synthesized
gtcttctcctggttacttagta

SEQ ID NO: 1399317 - DNA, 22 bp, Artificial Sequence
  chemically synthesized
catgctcaatctactaagtaac

SEQ ID NO: 1399318 - DNA, 22 bp, Artificial Sequence
  chemically synthesized
tacatttgtcttctcctggtta

SEQ ID NO: 1399319 - DNA, 22 bp, Artificial Sequence
  chemically synthesized
aatctactaagtaaccaggaga

SEQ ID NO: 1399320 - DNA, 22 bp, Artificial Sequence
  chemically synthesized
gtacatttgtcttctcctggtt

SEQ ID NO: 1399321 - DNA, 22 bp, Artificial Sequence
  chemically synthesized
ctaagtaaccaggagaagacaa

SEQ ID NO: 1399322 - DNA, 22 bp, Artificial Sequence
  chemically synthesized
agtaaccaggagaagacaaatg

SEQ ID NO: 1399323 - DNA, 22 bp, Artificial Sequence
  chemically synthesized
gaaatatcttgtacatttgtct

SEQ ID NO: 1399324 - DNA, 22 bp, Artificial Sequence
  chemically synthesized
ggaaatatcttgtacatttgtc

SEQ ID NO: 1399325 - DNA, 22 bp, Artificial Sequence
  chemically synthesized
ttggaaatatcttgtacatttg

SEQ ID NO: 1399326 - DNA, 22 bp, Artificial Sequence
  chemically synthesized
gtaacaagaatgctcttggaaa

SEQ ID NO: 1399327 - DNA, 22 bp, Artificial Sequence
  chemically synthesized
agttggtaacaagaatgctctt

SEQ ID NO: 1399328 - DNA, 22 bp, Artificial Sequence
  chemically synthesized
cagttggtaacaagaatgctct

SEQ ID NO: 1399329 - DNA, 22 bp, Artificial Sequence
  chemically synthesized
ttcagttggtaacaagaatgct

SEQ ID NO: 1399330 - DNA, 22 bp, Artificial Sequence
  chemically synthesized
ccaagagcattcttgttaccaa

SEQ ID NO: 1399331 - DNA, 22 bp, Artificial Sequence
  chemically synthesized
caagagcattcttgttaccaac

SEQ ID NO: 1399332 - DNA, 22 bp, Artificial Sequence
  chemically synthesized
atacagttcttcagttggtaac

SEQ ID NO: 1399333 - DNA, 22 bp, Artificial Sequence
  chemically synthesized
ttaatacagttcttcagttggt

SEQ ID NO: 1399334 - DNA, 22 bp, Artificial Sequence
  chemically synthesized
aattattaatacagttcttcag

SEQ ID NO: 1399335 - DNA, 22 bp, Artificial Sequence
  chemically synthesized
ttgttaccaactgaagaactgt

SEQ ID NO: 1399336 - DNA, 22 bp, Artificial Sequence
  chemically synthesized
gttaccaactgaagaactgtat

SEQ ID NO: 1399337 - DNA, 22 bp, Artificial Sequence
  chemically synthesized
ttaccaactgaagaactgtatt

SEQ ID NO: 1399338 - DNA, 22 bp, Artificial Sequence
  chemically synthesized
ccaactgaagaactgtattaat

SEQ ID NO: 1399339 - DNA, 22 bp, Artificial Sequence
  chemically synthesized
tataggactgaattattaatac

SEQ ID NO: 1399340 - DNA, 22 bp, Artificial Sequence
  chemically synthesized
aagaactgtattaataattcag

SEQ ID NO: 1399341 - DNA, 22 bp, Artificial Sequence
  chemically synthesized
agtagcactgtataggactgaa

SEQ ID NO: 1399342 - DNA, 22 bp, Artificial Sequence
  chemically synthesized
taagtagcactgtataggactg

SEQ ID NO: 1399343 - DNA, 22 bp, Artificial Sequence
  chemically synthesized
tattaataattcagtcctatac

SEQ ID NO: 1399344 - DNA, 22 bp, Artificial Sequence
  chemically synthesized
ataattcagtcctatacagtgc

SEQ ID NO: 1399345 - DNA, 22 bp, Artificial Sequence
  chemically synthesized
aagttctaagtagcactgtata

SEQ ID NO: 1399346 - DNA, 22 bp, Artificial Sequence
  chemically synthesized
agtcctatacagtgctacttag

SEQ ID NO: 1399347 - DNA, 22 bp, Artificial Sequence
  chemically synthesized
tacagtgctacttagaacttca

SEQ ID NO: 1399348 - DNA, 22 bp, Artificial Sequence
  chemically synthesized
acaagaagacactgaagttcta

SEQ ID NO: 1399349 - DNA, 22 bp, Artificial Sequence
  chemically synthesized
aacaagaagacactgaagttct

SEQ ID NO: 1399350 - DNA, 22 bp, Artificial Sequence
  chemically synthesized
gcttaacaagaagacactgaag

SEQ ID NO: 1399351 - DNA, 22 bp, Artificial Sequence
  chemically synthesized
cgcttaacaagaagacactgaa

SEQ ID NO: 1399352 - DNA, 22 bp, Artificial Sequence
  chemically synthesized
cttagaacttcagtgtcttctt

SEQ ID NO: 1399353 - DNA, 22 bp, Artificial Sequence
  chemically synthesized
agaacttcagtgtcttcttgtt

SEQ ID NO: 1399354 - DNA, 22 bp, Artificial Sequence
  chemically synthesized
gaacttcagtgtcttcttgtta

SEQ ID NO: 1399355 - DNA, 22 bp, Artificial Sequence
  chemically synthesized
catccacttcgcttaacaagaa

SEQ ID NO: 1399356 - DNA, 22 bp, Artificial Sequence
  chemically synthesized
acatccacttcgcttaacaaga

SEQ ID NO: 1399357 - DNA, 22 bp, Artificial Sequence
  chemically synthesized
tacatccacttcgcttaacaag

SEQ ID NO: 1399358 - DNA, 22 bp, Artificial Sequence
  chemically synthesized
ttacatccacttcgcttaacaa

SEQ ID NO: 1399359 - DNA, 22 bp, Artificial Sequence
  chemically synthesized
tttacatccacttcgcttaaca

SEQ ID NO: 1399360 - DNA, 22 bp, Artificial Sequence
  chemically synthesized
cagtgtcttcttgttaagcgaa

SEQ ID NO: 1399361 - DNA, 22 bp, Artificial Sequence
  chemically synthesized
ttttacatccacttcgcttaac

SEQ ID NO: 1399362 - DNA, 22 bp, Artificial Sequence
  chemically synthesized
agtgtcttcttgttaagcgaag

SEQ ID NO: 1399363 - DNA, 22 bp, Artificial Sequence
  chemically synthesized
tttttacatccacttcgcttaa

SEQ ID NO: 1399364 - DNA, 22 bp, Artificial Sequence
  chemically synthesized
ttttttacatccacttcgctta

SEQ ID NO: 1399365 - DNA, 22 bp, Artificial Sequence
  chemically synthesized
tttttttacatccacttcgctt

SEQ ID NO: 1399366 - DNA, 22 bp, Artificial Sequence
  chemically synthesized
ttttttttacatccacttcgct

SEQ ID NO: 1399367 - DNA, 22 bp, Artificial Sequence
  chemically synthesized
tttttttttacatccacttcgc

SEQ ID NO: 1399368 - DNA, 22 bp, Artificial Sequence
  chemically synthesized
ttttttttttacatccacttcg

SEQ ID NO: 1399369 - DNA, 22 bp, Artificial Sequence
  chemically synthesized
tttttttttttacatccacttc

SEQ ID NO: 1399370 - DNA, 22 bp, Artificial Sequence
  chemically synthesized
cttgttaagcgaagtggatgta

SEQ ID NO: 1399371 - DNA, 22 bp, Artificial Sequence
  chemically synthesized
ttgttaagcgaagtggatgtaa

SEQ ID NO: 1399372 - DNA, 22 bp, Artificial Sequence
  chemically synthesized
gttaagcgaagtggatgtaaaa

SEQ ID NO: 1399373 - DNA, 22 bp, Artificial Sequence
  chemically synthesized
cattttttttttttttacatcc

SEQ ID NO: 1399374 - DNA, 22 bp, Artificial Sequence
  chemically synthesized
ttaagcgaagtggatgtaaaaa

SEQ ID NO: 1399375 - DNA, 22 bp, Artificial Sequence
  chemically synthesized
gcattttttttttttttacatc

SEQ ID NO: 1399376 - DNA, 22 bp, Artificial Sequence
  chemically synthesized
tgcattttttttttttttacat

SEQ ID NO: 1399377 - DNA, 22 bp, Artificial Sequence
  chemically synthesized
agcgaagtggatgtaaaaaaaa

SEQ ID NO: 1399378 - DNA, 22 bp, Artificial Sequence
  chemically synthesized
ctttgcatttttttttttttta

SEQ ID NO: 1399379 - DNA, 22 bp, Artificial Sequence
  chemically synthesized
tgacattcctttgcattttttt

SEQ ID NO: 1399380 - DNA, 22 bp, Artificial Sequence
  chemically synthesized
atgacattcctttgcatttttt

SEQ ID NO: 1399381 - DNA, 22 bp, Artificial Sequence
  chemically synthesized
catttatgacattcctttgcat

SEQ ID NO: 1399382 - DNA, 22 bp, Artificial Sequence
  chemically synthesized
actgcatttatgacattccttt

SEQ ID NO: 1399383 - DNA, 22 bp, Artificial Sequence
  chemically synthesized
tattcactgcatttatgacatt

SEQ ID NO: 1399384 - DNA, 22 bp, Artificial Sequence
  chemically synthesized
gtattcactgcatttatgacat

SEQ ID NO: 1399385 - DNA, 22 bp, Artificial Sequence
  chemically synthesized
tgtattcactgcatttatgaca

SEQ ID NO: 1399386 - DNA, 22 bp, Artificial Sequence
  chemically synthesized
agctttgtattcactgcattta

SEQ ID NO: 1399387 - DNA, 22 bp, Artificial Sequence
  chemically synthesized
gaaattcagctttgtattcact

SEQ ID NO: 1399388 - DNA, 22 bp, Artificial Sequence
  chemically synthesized
agaaattcagctttgtattcac

SEQ ID NO: 1399389 - DNA, 22 bp, Artificial Sequence
  chemically synthesized
tagaaattcagctttgtattca

SEQ ID NO: 1399390 - DNA, 22 bp, Artificial Sequence
  chemically synthesized
ttagaaattcagctttgtattc

SEQ ID NO: 1399391 - DNA, 22 bp, Artificial Sequence
  chemically synthesized
tttagaaattcagctttgtatt

SEQ ID NO: 1399392 - DNA, 22 bp, Artificial Sequence
  chemically synthesized
cactttttagaaattcagcttt

SEQ ID NO: 1399393 - DNA, 22 bp, Artificial Sequence
  chemically synthesized
caagctccactttttagaaatt

SEQ ID NO: 1399394 - DNA, 22 bp, Artificial Sequence
  chemically synthesized
gcaagctccactttttagaaat

SEQ ID NO: 1399395 - DNA, 22 bp, Artificial Sequence
  chemically synthesized
tgcaagctccactttttagaaa

SEQ ID NO: 1399396 - DNA, 22 bp, Artificial Sequence
  chemically synthesized
cagtccctttgcaagctccact

SEQ ID NO: 1399397 - DNA, 22 bp, Artificial Sequence
  chemically synthesized
aatttctaaaaagtggagcttg

SEQ ID NO: 1399398 - DNA, 22 bp, Artificial Sequence
  chemically synthesized
ctaaaaagtggagcttgcaaag

SEQ ID NO: 1399399 - DNA, 22 bp, Artificial Sequence
  chemically synthesized
cacctacagtccctttgcaagc

SEQ ID NO: 1399400 - DNA, 22 bp, Artificial Sequence
  chemically synthesized
taaaaagtggagcttgcaaagg

SEQ ID NO: 1399401 - DNA, 22 bp, Artificial Sequence
  chemically synthesized
aaaagtggagcttgcaaaggga

SEQ ID NO: 1399402 - DNA, 22 bp, Artificial Sequence
  chemically synthesized
aattgcacctacagtccctttg

SEQ ID NO: 1399403 - DNA, 22 bp, Artificial Sequence
  chemically synthesized
aaactaaattgcacctacagtc

SEQ ID NO: 1399404 - DNA, 22 bp, Artificial Sequence
  chemically synthesized
caaactaaattgcacctacagt

SEQ ID NO: 1399405 - DNA, 22 bp, Artificial Sequence
  chemically synthesized
tttcaaactaaattgcacctac

SEQ ID NO: 1399406 - DNA, 22 bp, Artificial Sequence
  chemically synthesized
gcaaagggactgtaggtgcaat

SEQ ID NO: 1399407 - DNA, 22 bp, Artificial Sequence
  chemically synthesized
caaagggactgtaggtgcaatt

SEQ ID NO: 1399408 - DNA, 22 bp, Artificial Sequence
  chemically synthesized
atacctatttcaaactaaattg

SEQ ID NO: 1399409 - DNA, 22 bp, Artificial Sequence
  chemically synthesized
catacctatttcaaactaaatt

SEQ ID NO: 1399410 - DNA, 22 bp, Artificial Sequence
  chemically synthesized
atttcatacctatttcaaacta

SEQ ID NO: 1399411 - DNA, 22 bp, Artificial Sequence
  chemically synthesized
taggtgcaatttagtttgaaat

SEQ ID NO: 1399412 - DNA, 22 bp, Artificial Sequence
  chemically synthesized
gatttcatacctatttcaaact

SEQ ID NO: 1399413 - DNA, 22 bp, Artificial Sequence
  chemically synthesized
tgatttcatacctatttcaaac

SEQ ID NO: 1399414 - DNA, 22 bp, Artificial Sequence
  chemically synthesized
aaattttgatttcatacctatt

SEQ ID NO: 1399415 - DNA, 22 bp, Artificial Sequence
  chemically synthesized
ttaaaattttgatttcatacct

SEQ ID NO: 1399416 - DNA, 22 bp, Artificial Sequence
  chemically synthesized
agtttgaaataggtatgaaatc

SEQ ID NO: 1399417 - DNA, 22 bp, Artificial Sequence
  chemically synthesized
gtttgaaataggtatgaaatca

SEQ ID NO: 1399418 - DNA, 22 bp, Artificial Sequence
  chemically synthesized
ttattaaaattttgatttcata

SEQ ID NO: 1399419 - DNA, 22 bp, Artificial Sequence
  chemically synthesized
gttattaaaattttgatttcat

SEQ ID NO: 1399420 - DNA, 22 bp, Artificial Sequence
  chemically synthesized
gaaataggtatgaaatcaaaat

SEQ ID NO: 1399421 - DNA, 22 bp, Artificial Sequence
  chemically synthesized
aaataggtatgaaatcaaaatt

SEQ ID NO: 1399422 - DNA, 22 bp, Artificial Sequence
  chemically synthesized
gtatacaaagtgacacttgtta

SEQ ID NO: 1399423 - DNA, 22 bp, Artificial Sequence
  chemically synthesized
ggtatacaaagtgacacttgtt

SEQ ID NO: 1399424 - DNA, 22 bp, Artificial Sequence
  chemically synthesized
tggtatacaaagtgacacttgt

SEQ ID NO: 1399425 - DNA, 22 bp, Artificial Sequence
  chemically synthesized
taataacaagtgtcactttgta

SEQ ID NO: 1399426 - DNA, 22 bp, Artificial Sequence
  chemically synthesized
aataacaagtgtcactttgtat

SEQ ID NO: 1399427 - DNA, 22 bp, Artificial Sequence
  chemically synthesized
ataacaagtgtcactttgtata

SEQ ID NO: 1399428 - DNA, 22 bp, Artificial Sequence
  chemically synthesized
atgaacaggttttggtatacaa

SEQ ID NO: 1399429 - DNA, 22 bp, Artificial Sequence
  chemically synthesized
tattgatgaacaggttttggta

SEQ ID NO: 1399430 - DNA, 22 bp, Artificial Sequence
  chemically synthesized
attatattgatgaacaggtttt

SEQ ID NO: 1399431 - DNA, 22 bp, Artificial Sequence
  chemically synthesized
gattatattgatgaacaggttt

SEQ ID NO: 1399432 - DNA, 22 bp, Artificial Sequence
  chemically synthesized
tgtataccaaaacctgttcatc

SEQ ID NO: 1399433 - DNA, 22 bp, Artificial Sequence
  chemically synthesized
gtataccaaaacctgttcatca

SEQ ID NO: 1399434 - DNA, 22 bp, Artificial Sequence
  chemically synthesized
tataccaaaacctgttcatcaa

SEQ ID NO: 1399435 - DNA, 22 bp, Artificial Sequence
  chemically synthesized
ggtgtttgattatattgatgaa

SEQ ID NO: 1399436 - DNA, 22 bp, Artificial Sequence
  chemically synthesized
ttcatcaatataatcaaacacc

SEQ ID NO: 1399437 - DNA, 22 bp, Artificial Sequence
  chemically synthesized
atcaatataatcaaacacctag

SEQ ID NO: 1399438 - DNA, 22 bp, Artificial Sequence
  chemically synthesized
atggtaaacatcatcaaggcag

SEQ ID NO: 1399439 - DNA, 22 bp, Artificial Sequence
  chemically synthesized
gatatccatctgccttgatgat

SEQ ID NO: 1399440 - DNA, 22 bp, Artificial Sequence
  chemically synthesized
tgaaattcatggtaaacatcat

SEQ ID NO: 1399441 - DNA, 22 bp, Artificial Sequence
  chemically synthesized
ggattatgaaattcatggtaaa

SEQ ID NO: 1399442 - DNA, 22 bp, Artificial Sequence
  chemically synthesized
ccttgatgatgtttaccatgaa

SEQ ID NO: 1399443 - DNA, 22 bp, Artificial Sequence
  chemically synthesized
gggattatgaaattcatggtaa

SEQ ID NO: 1399444 - DNA, 22 bp, Artificial Sequence
  chemically synthesized
gatgatgtttaccatgaatttc

SEQ ID NO: 1399445 - DNA, 22 bp, Artificial Sequence
  chemically synthesized
acttgggattatgaaattcatg

SEQ ID NO: 1399446 - DNA, 22 bp, Artificial Sequence
  chemically synthesized
atgatgtttaccatgaatttca

SEQ ID NO: 1399447 - DNA, 22 bp, Artificial Sequence
  chemically synthesized
gacttgggattatgaaattcat

SEQ ID NO: 1399448 - DNA, 22 bp, Artificial Sequence
  chemically synthesized
ggtttgacttgggattatgaaa

SEQ ID NO: 1399449 - DNA, 22 bp, Artificial Sequence
  chemically synthesized
accatgaatttcataatcccaa

SEQ ID NO: 1399450 - DNA, 22 bp, Artificial Sequence
  chemically synthesized
ccatgaatttcataatcccaag

SEQ ID NO: 1399451 - DNA, 22 bp, Artificial Sequence
  chemically synthesized
cataatcccaagtcaaacccag

SEQ ID NO: 1399452 - DNA, 22 bp, Artificial Sequence
  chemically synthesized
ataatcccaagtcaaacccagt

SEQ ID NO: 1399453 - DNA, 22 bp, Artificial Sequence
  chemically synthesized
acaaatatgtgagtagaataca

SEQ ID NO: 1399454 - DNA, 22 bp, Artificial Sequence
  chemically synthesized
atgacagctcacaaatatgtga

SEQ ID NO: 1399455 - DNA, 22 bp, Artificial Sequence
  chemically synthesized
aatgacagctcacaaatatgtg

SEQ ID NO: 1399456 - DNA, 22 bp, Artificial Sequence
  chemically synthesized
taatgacagctcacaaatatgt

SEQ ID NO: 1399457 - DNA, 22 bp, Artificial Sequence
  chemically synthesized
ctttaatgacagctcacaaata

SEQ ID NO: 1399458 - DNA, 22 bp, Artificial Sequence
  chemically synthesized
cctttaatgacagctcacaaat

SEQ ID NO: 1399459 - DNA, 22 bp, Artificial Sequence
  chemically synthesized
tactcacatatttgtgagctgt

SEQ ID NO: 1399460 - DNA, 22 bp, Artificial Sequence
  chemically synthesized
gcttcctttaatgacagctcac

SEQ ID NO: 1399461 - DNA, 22 bp, Artificial Sequence
  chemically synthesized
ctcacatatttgtgagctgtca

SEQ ID NO: 1399462 - DNA, 22 bp, Artificial Sequence
  chemically synthesized
tagcttcctttaatgacagctc

SEQ ID NO: 1399463 - DNA, 22 bp, Artificial Sequence
  chemically synthesized
acatatttgtgagctgtcatta

SEQ ID NO: 1399464 - DNA, 22 bp, Artificial Sequence
  chemically synthesized
ttctagcttcctttaatgacag

SEQ ID NO: 1399465 - DNA, 22 bp, Artificial Sequence
  chemically synthesized
tgttctagcttcctttaatgac

SEQ ID NO: 1399466 - DNA, 22 bp, Artificial Sequence
  chemically synthesized
gtgagctgtcattaaaggaagc

SEQ ID NO: 1399467 - DNA, 22 bp, Artificial Sequence
  chemically synthesized
cattctgttctagcttccttta

SEQ ID NO: 1399468 - DNA, 22 bp, Artificial Sequence
  chemically synthesized
tgagctgtcattaaaggaagct

SEQ ID NO: 1399469 - DNA, 22 bp, Artificial Sequence
  chemically synthesized
tcattaaaggaagctagaacag

SEQ ID NO: 1399470 - DNA, 22 bp, Artificial Sequence
  chemically synthesized
aaggaagctagaacagaatgta

SEQ ID NO: 1399471 - DNA, 22 bp, Artificial Sequence
  chemically synthesized
gaacagaatgtagtatgtcata

SEQ ID NO: 1399472 - DNA, 22 bp, Artificial Sequence
  chemically synthesized
cacacacacacacacacatata

SEQ ID NO: 1399473 - DNA, 22 bp, Artificial Sequence
  chemically synthesized
acattacacacacacacacaca

SEQ ID NO: 1399474 - DNA, 22 bp, Artificial Sequence
  chemically synthesized
tcacattacacacacacacaca

SEQ ID NO: 1399475 - DNA, 22 bp, Artificial Sequence
  chemically synthesized
cataaatgcacattctcacatt

SEQ ID NO: 1399476 - DNA, 22 bp, Artificial Sequence
  chemically synthesized
agttgcataaatgcacattctc

SEQ ID NO: 1399477 - DNA, 22 bp, Artificial Sequence
  chemically synthesized
aaggcacacaaacacacactca

SEQ ID NO: 1399478 - DNA, 22 bp, Artificial Sequence
  chemically synthesized
atgcaactgagtgtgtgtttgt

SEQ ID NO: 1399479 - DNA, 22 bp, Artificial Sequence
  chemically synthesized
acctcaaggcacacaaacacac

SEQ ID NO: 1399480 - DNA, 22 bp, Artificial Sequence
  chemically synthesized
tgcaactgagtgtgtgtttgtg

SEQ ID NO: 1399481 - DNA, 22 bp, Artificial Sequence
  chemically synthesized
aacctcaaggcacacaaacaca

SEQ ID NO: 1399482 - DNA, 22 bp, Artificial Sequence
  chemically synthesized
agtgtgtgtttgtgtgccttga

SEQ ID NO: 1399483 - DNA, 22 bp, Artificial Sequence
  chemically synthesized
tacatcttaacctcaaggcaca

SEQ ID NO: 1399484 - DNA, 22 bp, Artificial Sequence
  chemically synthesized
gtacatcttaacctcaaggcac

SEQ ID NO: 1399485 - DNA, 22 bp, Artificial Sequence
  chemically synthesized
ttgtacatcttaacctcaaggc

SEQ ID NO: 1399486 - DNA, 22 bp, Artificial Sequence
  chemically synthesized
cttgtacatcttaacctcaagg

SEQ ID NO: 1399487 - DNA, 22 bp, Artificial Sequence
  chemically synthesized
cttcttgtacatcttaacctca

SEQ ID NO: 1399488 - DNA, 22 bp, Artificial Sequence
  chemically synthesized
acttcttgtacatcttaacctc

SEQ ID NO: 1399489 - DNA, 22 bp, Artificial Sequence
  chemically synthesized
gtgtgccttgaggttaagatgt

SEQ ID NO: 1399490 - DNA, 22 bp, Artificial Sequence
  chemically synthesized
tgtgccttgaggttaagatgta

SEQ ID NO: 1399491 - DNA, 22 bp, Artificial Sequence
  chemically synthesized
caaatgcttacttcttgtacat

SEQ ID NO: 1399492 - DNA, 22 bp, Artificial Sequence
  chemically synthesized
ccaaatgcttacttcttgtaca

SEQ ID NO: 1399493 - DNA, 22 bp, Artificial Sequence
  chemically synthesized
tccaaatgcttacttcttgtac

SEQ ID NO: 1399494 - DNA, 22 bp, Artificial Sequence
  chemically synthesized
gaggttaagatgtacaagaagt

SEQ ID NO: 1399495 - DNA, 22 bp, Artificial Sequence
  chemically synthesized
aggttaagatgtacaagaagta

SEQ ID NO: 1399496 - DNA, 22 bp, Artificial Sequence
  chemically synthesized
agatgtacaagaagtaagcatt

SEQ ID NO: 1399497 - DNA, 22 bp, Artificial Sequence
  chemically synthesized
ggaaagtttgctttgacattac

SEQ ID NO: 1399498 - DNA, 22 bp, Artificial Sequence
  chemically synthesized
gaaagtttgctttgacattaca

SEQ ID NO: 1399499 - DNA, 22 bp, Artificial Sequence
  chemically synthesized
gctttgacattacacacgcaca

SEQ ID NO: 1399500 - DNA, 22 bp, Artificial Sequence
  chemically synthesized
tgtgtgtgtgtgtgtgcgtgtg

SEQ ID NO: 1399501 - DNA, 22 bp, Artificial Sequence
  chemically synthesized
ctttgacattacacacgcacac

SEQ ID NO: 1399502 - DNA, 22 bp, Artificial Sequence
  chemically synthesized
tgacattacacacgcacacaca

SEQ ID NO: 1399503 - DNA, 22 bp, Artificial Sequence
  chemically synthesized
gacattacacacgcacacacac

SEQ ID NO: 1399504 - DNA, 22 bp, Artificial Sequence
  chemically synthesized
acattacacacgcacacacaca

SEQ ID NO: 1399505 - DNA, 22 bp, Artificial Sequence
  chemically synthesized
cacacgcacacacacacacaca

SEQ ID NO: 1399506 - DNA, 22 bp, Artificial Sequence
  chemically synthesized
tgtagatatatacataaatggg

SEQ ID NO: 1399507 - DNA, 22 bp, Artificial Sequence
  chemically synthesized
gtgtagatatatacataaatgg

SEQ ID NO: 1399508 - DNA, 22 bp, Artificial Sequence
  chemically synthesized
tgtttgtgtagatatatacata

SEQ ID NO: 1399509 - DNA, 22 bp, Artificial Sequence
  chemically synthesized
tgtctatgtttgtgtagatata

SEQ ID NO: 1399510 - DNA, 22 bp, Artificial Sequence
  chemically synthesized
ttatgtctatgtttgtgtagat

SEQ ID NO: 1399511 - DNA, 22 bp, Artificial Sequence
  chemically synthesized
atgtatatatctacacaaacat

SEQ ID NO: 1399512 - DNA, 22 bp, Artificial Sequence
  chemically synthesized
tgtatatatctacacaaacata

SEQ ID NO: 1399513 - DNA, 22 bp, Artificial Sequence
  chemically synthesized
atataattattatgtctatgtt

SEQ ID NO: 1399514 - DNA, 22 bp, Artificial Sequence
  chemically synthesized
aatataattattatgtctatgt

SEQ ID NO: 1399515 - DNA, 22 bp, Artificial Sequence
  chemically synthesized
cacaaacatagacataataatt

SEQ ID NO: 1399516 - DNA, 22 bp, Artificial Sequence
  chemically synthesized
gtagagtttaatataattatta

SEQ ID NO: 1399517 - DNA, 22 bp, Artificial Sequence
  chemically synthesized
tatgagcaataggaaactagta

SEQ ID NO: 1399518 - DNA, 22 bp, Artificial Sequence
  chemically synthesized
tattaaactctactagtttcct

SEQ ID NO: 1399519 - DNA, 22 bp, Artificial Sequence
  chemically synthesized
ttatatgagcaataggaaacta

SEQ ID NO: 1399520 - DNA, 22 bp, Artificial Sequence
  chemically synthesized
attatatgagcaataggaaact

SEQ ID NO: 1399521 - DNA, 22 bp, Artificial Sequence
  chemically synthesized
aactctactagtttcctattgc

SEQ ID NO: 1399522 - DNA, 22 bp, Artificial Sequence
  chemically synthesized
tactagtttcctattgctcata

SEQ ID NO: 1399523 - DNA, 22 bp, Artificial Sequence
  chemically synthesized
ctagtttcctattgctcatata

SEQ ID NO: 1399524 - DNA, 22 bp, Artificial Sequence
  chemically synthesized
atggtaatttattatatgagca

SEQ ID NO: 1399525 - DNA, 22 bp, Artificial Sequence
  chemically synthesized
gtttcctattgctcatataata

SEQ ID NO: 1399526 - DNA, 22 bp, Artificial Sequence
  chemically synthesized
agttcatggtaatttattatat

SEQ ID NO: 1399527 - DNA, 22 bp, Artificial Sequence
  chemically synthesized
cctattgctcatataataaatt

SEQ ID NO: 1399528 - DNA, 22 bp, Artificial Sequence
  chemically synthesized
ctattgctcatataataaatta

SEQ ID NO: 1399529 - DNA, 22 bp, Artificial Sequence
  chemically synthesized
ttgctcatataataaattacca

SEQ ID NO: 1399530 - DNA, 22 bp, Artificial Sequence
  chemically synthesized
aatcactaagttcatggtaatt

SEQ ID NO: 1399531 - DNA, 22 bp, Artificial Sequence
  chemically synthesized
ctcatataataaattaccatga

SEQ ID NO: 1399532 - DNA, 22 bp, Artificial Sequence
  chemically synthesized
aaatcactaagttcatggtaat

SEQ ID NO: 1399533 - DNA, 22 bp, Artificial Sequence
  chemically synthesized
atataataaattaccatgaact

SEQ ID NO: 1399534 - DNA, 22 bp, Artificial Sequence
  chemically synthesized
ccatgaacttagtgatttaaat

SEQ ID NO: 1399535 - DNA, 22 bp, Artificial Sequence
  chemically synthesized
agtgatttaaatgtacatatat

SEQ ID NO: 1399536 - DNA, 22 bp, Artificial Sequence
  chemically synthesized
gtgatttaaatgtacatatatt

SEQ ID NO: 1399537 - DNA, 22 bp, Artificial Sequence
  chemically synthesized
aaatgtacatatattttttatc

SEQ ID NO: 1399538 - DNA, 22 bp, Artificial Sequence
  chemically synthesized
aaaaaaataaaagataaaaaat

SEQ ID NO: 1399539 - DNA, 22 bp, Artificial Sequence
  chemically synthesized
aatgtacatatattttttatct

SEQ ID NO: 1399540 - DNA, 22 bp, Artificial Sequence
  chemically synthesized
tctcaaaaaaataaaagataaa

SEQ ID NO: 1399541 - DNA, 22 bp, Artificial Sequence
  chemically synthesized
tgtctcaaaaaaataaaagata

SEQ ID NO: 1399542 - DNA, 22 bp, Artificial Sequence
  chemically synthesized
agactctgtctcaaaaaaataa

SEQ ID NO: 1399543 - DNA, 22 bp, Artificial Sequence
  chemically synthesized
tttatcttttatttttttgaga

SEQ ID NO: 1399544 - DNA, 22 bp, Artificial Sequence
  chemically synthesized
ttatcttttatttttttgagac

SEQ ID NO: 1399545 - DNA, 22 bp, Artificial Sequence
  chemically synthesized
tatcttttatttttttgagaca

SEQ ID NO: 1399546 - DNA, 22 bp, Artificial Sequence
  chemically synthesized
atcttttatttttttgagacag

SEQ ID NO: 1399547 - DNA, 22 bp, Artificial Sequence
  chemically synthesized
tcttttatttttttgagacaga

SEQ ID NO: 1399548 - DNA, 22 bp, Artificial Sequence
  chemically synthesized
ttatttttttgagacagagtct

SEQ ID NO: 1399549 - DNA, 22 bp, Artificial Sequence
  chemically synthesized
tatttttttgagacagagtctc

SEQ ID NO: 1399550 - DNA, 22 bp, Artificial Sequence
  chemically synthesized
atttttttgagacagagtctca

SEQ ID NO: 1399551 - DNA, 22 bp, Artificial Sequence
  chemically synthesized
tttttttgagacagagtctcag

SEQ ID NO: 1399552 - DNA, 22 bp, Artificial Sequence
  chemically synthesized
ggcgacagagtgactgagactc

SEQ ID NO: 1399553 - DNA, 22 bp, Artificial Sequence
  chemically synthesized
ttttgagacagagtctcagtca

SEQ ID NO: 1399554 - DNA, 22 bp, Artificial Sequence
  chemically synthesized
tttgagacagagtctcagtcac

SEQ ID NO: 1399555 - DNA, 22 bp, Artificial Sequence
  chemically synthesized
ttgagacagagtctcagtcact

SEQ ID NO: 1399556 - DNA, 22 bp, Artificial Sequence
  chemically synthesized
tgagacagagtctcagtcactc

SEQ ID NO: 1399557 - DNA, 22 bp, Artificial Sequence
  chemically synthesized
gagacagagtctcagtcactct

SEQ ID NO: 1399558 - DNA, 22 bp, Artificial Sequence
  chemically synthesized
agacagagtctcagtcactctg

SEQ ID NO: 1399559 - DNA, 22 bp, Artificial Sequence
  chemically synthesized
cagcctgggcgacagagtgact

SEQ ID NO: 1399560 - DNA, 22 bp, Artificial Sequence
  chemically synthesized
agtcactctgtcgcccaggctg

SEQ ID NO: 1399561 - DNA, 22 bp, Artificial Sequence
  chemically synthesized
tgtcgcccaggctggagtgtgg

SEQ ID NO: 1399562 - DNA, 22 bp, Artificial Sequence
  chemically synthesized
tcgcccaggctggagtgtggtg

SEQ ID NO: 1399563 - DNA, 22 bp, Artificial Sequence
  chemically synthesized
cagtgagccgagatcgtgccac

SEQ ID NO: 1399564 - DNA, 22 bp, Artificial Sequence
  chemically synthesized
gagtgtggtggcacgatctcgg

SEQ ID NO: 1399565 - DNA, 22 bp, Artificial Sequence
  chemically synthesized
ggagatagaggttgcagtgagc

SEQ ID NO: 1399566 - DNA, 22 bp, Artificial Sequence
  chemically synthesized
ggcctgggagatagaggttgca

SEQ ID NO: 1399567 - DNA, 22 bp, Artificial Sequence
  chemically synthesized
gggcctgggagatagaggttgc

SEQ ID NO: 1399568 - DNA, 22 bp, Artificial Sequence
  chemically synthesized
cttgggcctgggagatagaggt

SEQ ID NO: 1399569 - DNA, 22 bp, Artificial Sequence
  chemically synthesized
ggctcactgcaacctctatctc

SEQ ID NO: 1399570 - DNA, 22 bp, Artificial Sequence
  chemically synthesized
actgcaacctctatctcccagg

SEQ ID NO: 1399571 - DNA, 22 bp, Artificial Sequence
  chemically synthesized
caacctctatctcccaggccca

SEQ ID NO: 1399572 - DNA, 22 bp, Artificial Sequence
  chemically synthesized
aggcatcagaattgcttgggcc

SEQ ID NO: 1399573 - DNA, 22 bp, Artificial Sequence
  chemically synthesized
tatctcccaggcccaagcaatt

SEQ ID NO: 1399574 - DNA, 22 bp, Artificial Sequence
  chemically synthesized
tctcccaggcccaagcaattct

SEQ ID NO: 1399575 - DNA, 22 bp, Artificial Sequence
  chemically synthesized
ggaagctgaggcatcagaattg

SEQ ID NO: 1399576 - DNA, 22 bp, Artificial Sequence
  chemically synthesized
ccaggcccaagcaattctgatg

SEQ ID NO: 1399577 - DNA, 22 bp, Artificial Sequence
  chemically synthesized
gggaagctgaggcatcagaatt

SEQ ID NO: 1399578 - DNA, 22 bp, Artificial Sequence
  chemically synthesized
tagtcccagcgacttgggaagc

SEQ ID NO: 1399579 - DNA, 22 bp, Artificial Sequence
  chemically synthesized
tgatgcctcagcttcccaagtc

SEQ ID NO: 1399580 - DNA, 22 bp, Artificial Sequence
  chemically synthesized
atgcctcagcttcccaagtcgc

SEQ ID NO: 1399581 - DNA, 22 bp, Artificial Sequence
  chemically synthesized
agcttcccaagtcgctgggact

SEQ ID NO: 1399582 - DNA, 22 bp, Artificial Sequence
  chemically synthesized
cccaagtcgctgggactacagg

SEQ ID NO: 1399583 - DNA, 22 bp, Artificial Sequence
  chemically synthesized
ccaagtcgctgggactacaggc

SEQ ID NO: 1399584 - DNA, 22 bp, Artificial Sequence
  chemically synthesized
gggtggtgatgcacgcctgtag

SEQ ID NO: 1399585 - DNA, 22 bp, Artificial Sequence
  chemically synthesized
ggggtggtgatgcacgcctgta

SEQ ID NO: 1399586 - DNA, 22 bp, Artificial Sequence
  chemically synthesized
cttggggtggtgatgcacgcct

SEQ ID NO: 1399587 - DNA, 22 bp, Artificial Sequence
  chemically synthesized
gcttggggtggtgatgcacgcc

SEQ ID NO: 1399588 - DNA, 22 bp, Artificial Sequence
  chemically synthesized
ggactacaggcgtgcatcacca

SEQ ID NO: 1399589 - DNA, 22 bp, Artificial Sequence
  chemically synthesized
caggcgtgcatcaccaccccaa

SEQ ID NO: 1399590 - DNA, 22 bp, Artificial Sequence
  chemically synthesized
aaaatacaaaaatttgcttggg

SEQ ID NO: 1399591 - DNA, 22 bp, Artificial Sequence
  chemically synthesized
ctaaaaatacaaaaatttgctt

SEQ ID NO: 1399592 - DNA, 22 bp, Artificial Sequence
  chemically synthesized
tactaaaaatacaaaaatttgc

SEQ ID NO: 1399593 - DNA, 22 bp, Artificial Sequence
  chemically synthesized
ttgtatttttagtagagatggg

SEQ ID NO: 1399594 - DNA, 22 bp, Artificial Sequence
  chemically synthesized
tgtatttttagtagagatgggc

SEQ ID NO: 1399595 - DNA, 22 bp, Artificial Sequence
  chemically synthesized
gtatttttagtagagatgggct

SEQ ID NO: 1399596 - DNA, 22 bp, Artificial Sequence
  chemically synthesized
tatttttagtagagatgggctt

SEQ ID NO: 1399597 - DNA, 22 bp, Artificial Sequence
  chemically synthesized
gccaaaatggtaaaagcccatc

SEQ ID NO: 1399598 - DNA, 22 bp, Artificial Sequence
  chemically synthesized
ttagtagagatgggcttttacc

SEQ ID NO: 1399599 - DNA, 22 bp, Artificial Sequence
  chemically synthesized
cctggccaaaatggtaaaagcc

SEQ ID NO: 1399600 - DNA, 22 bp, Artificial Sequence
  chemically synthesized
tagtagagatgggcttttacca

SEQ ID NO: 1399601 - DNA, 22 bp, Artificial Sequence
  chemically synthesized
agtagagatgggcttttaccat

SEQ ID NO: 1399602 - DNA, 22 bp, Artificial Sequence
  chemically synthesized
gtagagatgggcttttaccatt

SEQ ID NO: 1399603 - DNA, 22 bp, Artificial Sequence
  chemically synthesized
agacctgcctggccaaaatggt

SEQ ID NO: 1399604 - DNA, 22 bp, Artificial Sequence
  chemically synthesized
gagacctgcctggccaaaatgg

SEQ ID NO: 1399605 - DNA, 22 bp, Artificial Sequence
  chemically synthesized
ttaccattttggccaggcaggt

SEQ ID NO: 1399606 - DNA, 22 bp, Artificial Sequence
  chemically synthesized
taccattttggccaggcaggtc

SEQ ID NO: 1399607 - DNA, 22 bp, Artificial Sequence
  chemically synthesized
accattttggccaggcaggtct

SEQ ID NO: 1399608 - DNA, 22 bp, Artificial Sequence
  chemically synthesized
ccattttggccaggcaggtctc

SEQ ID NO: 1399609 - DNA, 22 bp, Artificial Sequence
  chemically synthesized
tggccaggcaggtctcaaactc

SEQ ID NO: 1399610 - DNA, 22 bp, Artificial Sequence
  chemically synthesized
ggccaggcaggtctcaaactcc

SEQ ID NO: 1399611 - DNA, 22 bp, Artificial Sequence
  chemically synthesized
gccaggcaggtctcaaactcct

SEQ ID NO: 1399612 - DNA, 22 bp, Artificial Sequence
  chemically synthesized
aaactcctgacctcatgtgatc

SEQ ID NO: 1399613 - DNA, 22 bp, Artificial Sequence
  chemically synthesized
cgaggccaaggtggacggatca

SEQ ID NO: 1399614 - DNA, 22 bp, Artificial Sequence
  chemically synthesized
ctgacctcatgtgatccgtcca

SEQ ID NO: 1399615 - DNA, 22 bp, Artificial Sequence
  chemically synthesized
gcgaggccaaggtggacggatc

SEQ ID NO: 1399616 - DNA, 22 bp, Artificial Sequence
  chemically synthesized
tgcgaggccaaggtggacggat

SEQ ID NO: 1399617 - DNA, 22 bp, Artificial Sequence
  chemically synthesized
acctcatgtgatccgtccacct

SEQ ID NO: 1399618 - DNA, 22 bp, Artificial Sequence
  chemically synthesized
atgtgatccgtccaccttggcc

SEQ ID NO: 1399619 - DNA, 22 bp, Artificial Sequence
  chemically synthesized
ggcctcgcaaagtgttgggatt

SEQ ID NO: 1399620 - DNA, 22 bp, Artificial Sequence
  chemically synthesized
gcctcgcaaagtgttgggatta

SEQ ID NO: 1399621 - DNA, 22 bp, Artificial Sequence
  chemically synthesized
gcaaagtgttgggattacatgc

SEQ ID NO: 1399622 - DNA, 22 bp, Artificial Sequence
  chemically synthesized
ggcacagtggatcacgcatgta

SEQ ID NO: 1399623 - DNA, 22 bp, Artificial Sequence
  chemically synthesized
ggattacatgcgtgatccactg

SEQ ID NO: 1399624 - DNA, 22 bp, Artificial Sequence
  chemically synthesized
catgcgtgatccactgtgccca

SEQ ID NO: 1399625 - DNA, 22 bp, Artificial Sequence
  chemically synthesized
tgcccagcctgttttttttttg

SEQ ID NO: 1399626 - DNA, 22 bp, Artificial Sequence
  chemically synthesized
ttttttttttgttttttttttt

SEQ ID NO: 1399627 - DNA, 22 bp, Artificial Sequence
  chemically synthesized
agaaagataaaaaaaaaaaaaa

SEQ ID NO: 1399628 - DNA, 22 bp, Artificial Sequence
  chemically synthesized
tttttttgtttttttttttttt

SEQ ID NO: 1399629 - DNA, 22 bp, Artificial Sequence
  chemically synthesized
ttttttgttttttttttttttt

SEQ ID NO: 1399630 - DNA, 22 bp, Artificial Sequence
  chemically synthesized
taagaaagataaaaaaaaaaaa

SEQ ID NO: 1399631 - DNA, 22 bp, Artificial Sequence
  chemically synthesized
tttttgtttttttttttttttt

SEQ ID NO: 1399632 - DNA, 22 bp, Artificial Sequence
  chemically synthesized
ttttgttttttttttttttttt

SEQ ID NO: 1399633 - DNA, 22 bp, Artificial Sequence
  chemically synthesized
tttgttttttttttttttttta

SEQ ID NO: 1399634 - DNA, 22 bp, Artificial Sequence
  chemically synthesized
ttgtttttttttttttttttat

SEQ ID NO: 1399635 - DNA, 22 bp, Artificial Sequence
  chemically synthesized
tgtttttttttttttttttatc

SEQ ID NO: 1399636 - DNA, 22 bp, Artificial Sequence
  chemically synthesized
gtttttttttttttttttatct

SEQ ID NO: 1399637 - DNA, 22 bp, Artificial Sequence
  chemically synthesized
tttttttttttttttttatctt

SEQ ID NO: 1399638 - DNA, 22 bp, Artificial Sequence
  chemically synthesized
ttttttttttttttatctttct

SEQ ID NO: 1399639 - DNA, 22 bp, Artificial Sequence
  chemically synthesized
tttttttttttttatctttctt

SEQ ID NO: 1399640 - DNA, 22 bp, Artificial Sequence
  chemically synthesized
gtccagaactctaagaaagata

SEQ ID NO: 1399641 - DNA, 22 bp, Artificial Sequence
  chemically synthesized
ttttttttttttatctttctta

SEQ ID NO: 1399642 - DNA, 22 bp, Artificial Sequence
  chemically synthesized
agtccagaactctaagaaagat

SEQ ID NO: 1399643 - DNA, 22 bp, Artificial Sequence
  chemically synthesized
tttttttttttatctttcttag

SEQ ID NO: 1399644 - DNA, 22 bp, Artificial Sequence
  chemically synthesized
tagtccagaactctaagaaaga

SEQ ID NO: 1399645 - DNA, 22 bp, Artificial Sequence
  chemically synthesized
ttttttttttatctttcttaga

SEQ ID NO: 1399646 - DNA, 22 bp, Artificial Sequence
  chemically synthesized
tttttttttatctttcttagag

SEQ ID NO: 1399647 - DNA, 22 bp, Artificial Sequence
  chemically synthesized
ttttttttatctttcttagagt

SEQ ID NO: 1399648 - DNA, 22 bp, Artificial Sequence
  chemically synthesized
tttttttatctttcttagagtt

SEQ ID NO: 1399649 - DNA, 22 bp, Artificial Sequence
  chemically synthesized
gttttagtccagaactctaaga

SEQ ID NO: 1399650 - DNA, 22 bp, Artificial Sequence
  chemically synthesized
ttttttatctttcttagagttc

SEQ ID NO: 1399651 - DNA, 22 bp, Artificial Sequence
  chemically synthesized
ggttttagtccagaactctaag

SEQ ID NO: 1399652 - DNA, 22 bp, Artificial Sequence
  chemically synthesized
tttttatctttcttagagttct

SEQ ID NO: 1399653 - DNA, 22 bp, Artificial Sequence
  chemically synthesized
ttttatctttcttagagttctg

SEQ ID NO: 1399654 - DNA, 22 bp, Artificial Sequence
  chemically synthesized
tttatctttcttagagttctgg

SEQ ID NO: 1399655 - DNA, 22 bp, Artificial Sequence
  chemically synthesized
ttatctttcttagagttctgga

SEQ ID NO: 1399656 - DNA, 22 bp, Artificial Sequence
  chemically synthesized
tatctttcttagagttctggac

SEQ ID NO: 1399657 - DNA, 22 bp, Artificial Sequence
  chemically synthesized
atctttcttagagttctggact

SEQ ID NO: 1399658 - DNA, 22 bp, Artificial Sequence
  chemically synthesized
tctttcttagagttctggacta

SEQ ID NO: 1399659 - DNA, 22 bp, Artificial Sequence
  chemically synthesized
acaccttggttttagtccagaa

SEQ ID NO: 1399660 - DNA, 22 bp, Artificial Sequence
  chemically synthesized
tcttagagttctggactaaaac

SEQ ID NO: 1399661 - DNA, 22 bp, Artificial Sequence
  chemically synthesized
cttagagttctggactaaaacc

SEQ ID NO: 1399662 - DNA, 22 bp, Artificial Sequence
  chemically synthesized
ttagagttctggactaaaacca

SEQ ID NO: 1399663 - DNA, 22 bp, Artificial Sequence
  chemically synthesized
agagttctggactaaaaccaag

SEQ ID NO: 1399664 - DNA, 22 bp, Artificial Sequence
  chemically synthesized
gagttctggactaaaaccaagg

SEQ ID NO: 1399665 - DNA, 22 bp, Artificial Sequence
  chemically synthesized
tggactaaaaccaaggtgtcaa

SEQ ID NO: 1399666 - DNA, 22 bp, Artificial Sequence
  chemically synthesized
gactaaaaccaaggtgtcaatg

SEQ ID NO: 1399667 - DNA, 22 bp, Artificial Sequence
  chemically synthesized
aaaccaaggtgtcaatggggcg

SEQ ID NO: 1399668 - DNA, 22 bp, Artificial Sequence
  chemically synthesized
cagaatgaacagcgccccattg

SEQ ID NO: 1399669 - DNA, 22 bp, Artificial Sequence
  chemically synthesized
gagtctccagaatgaacagcgc

SEQ ID NO: 1399670 - DNA, 22 bp, Artificial Sequence
  chemically synthesized
ccctagagtctccagaatgaac

SEQ ID NO: 1399671 - DNA, 22 bp, Artificial Sequence
  chemically synthesized
tcccctagagtctccagaatga

SEQ ID NO: 1399672 - DNA, 22 bp, Artificial Sequence
  chemically synthesized
ttcattctggagactctagggg

SEQ ID NO: 1399673 - DNA, 22 bp, Artificial Sequence
  chemically synthesized
ggaaatggattctcccctagag

SEQ ID NO: 1399674 - DNA, 22 bp, Artificial Sequence
  chemically synthesized
attctggagactctaggggaga

SEQ ID NO: 1399675 - DNA, 22 bp, Artificial Sequence
  chemically synthesized
tggagactctaggggagaatcc

SEQ ID NO: 1399676 - DNA, 22 bp, Artificial Sequence
  chemically synthesized
gaagctaggaaatggattctcc

SEQ ID NO: 1399677 - DNA, 22 bp, Artificial Sequence
  chemically synthesized
gagactctaggggagaatccat

SEQ ID NO: 1399678 - DNA, 22 bp, Artificial Sequence
  chemically synthesized
tagaagctaggaaatggattct

SEQ ID NO: 1399679 - DNA, 22 bp, Artificial Sequence
  chemically synthesized
taggggagaatccatttcctag

SEQ ID NO: 1399680 - DNA, 22 bp, Artificial Sequence
  chemically synthesized
ggggagaatccatttcctagct

SEQ ID NO: 1399681 - DNA, 22 bp, Artificial Sequence
  chemically synthesized
cctagcttctagaggctgccta

SEQ ID NO: 1399682 - DNA, 22 bp, Artificial Sequence
  chemically synthesized
ctagcttctagaggctgcctac

SEQ ID NO: 1399683 - DNA, 22 bp, Artificial Sequence
  chemically synthesized
gcttctagaggctgcctacatt

SEQ ID NO: 1399684 - DNA, 22 bp, Artificial Sequence
  chemically synthesized
ctagaggctgcctacattcctt

SEQ ID NO: 1399685 - DNA, 22 bp, Artificial Sequence
  chemically synthesized
tagaggctgcctacattccttg

SEQ ID NO: 1399686 - DNA, 22 bp, Artificial Sequence
  chemically synthesized
gaggctgcctacattccttgat

SEQ ID NO: 1399687 - DNA, 22 bp, Artificial Sequence
  chemically synthesized
cctacattccttgattcatggc

SEQ ID NO: 1399688 - DNA, 22 bp, Artificial Sequence
  chemically synthesized
cattccttgattcatggcccct

SEQ ID NO: 1399689 - DNA, 22 bp, Artificial Sequence
  chemically synthesized
aaaatggaggaaaggggccatg

SEQ ID NO: 1399690 - DNA, 22 bp, Artificial Sequence
  chemically synthesized
gaaaatggaggaaaggggccat

SEQ ID NO: 1399691 - DNA, 22 bp, Artificial Sequence
  chemically synthesized
tgaaaatggaggaaaggggcca

SEQ ID NO: 1399692 - DNA, 22 bp, Artificial Sequence
  chemically synthesized
cttgattcatggcccctttcct

SEQ ID NO: 1399693 - DNA, 22 bp, Artificial Sequence
  chemically synthesized
ctttgaaaatggaggaaagggg

SEQ ID NO: 1399694 - DNA, 22 bp, Artificial Sequence
  chemically synthesized
gctttgaaaatggaggaaaggg

SEQ ID NO: 1399695 - DNA, 22 bp, Artificial Sequence
  chemically synthesized
gattcatggcccctttcctcca

SEQ ID NO: 1399696 - DNA, 22 bp, Artificial Sequence
  chemically synthesized
attcatggcccctttcctccat

SEQ ID NO: 1399697 - DNA, 22 bp, Artificial Sequence
  chemically synthesized
cttgctttgaaaatggaggaaa

SEQ ID NO: 1399698 - DNA, 22 bp, Artificial Sequence
  chemically synthesized
atggcccctttcctccattttc

SEQ ID NO: 1399699 - DNA, 22 bp, Artificial Sequence
  chemically synthesized
tactgcttgctttgaaaatgga

SEQ ID NO: 1399700 - DNA, 22 bp, Artificial Sequence
  chemically synthesized
tcctccattttcaaagcaagca

SEQ ID NO: 1399701 - DNA, 22 bp, Artificial Sequence
  chemically synthesized
cctccattttcaaagcaagcag

SEQ ID NO: 1399702 - DNA, 22 bp, Artificial Sequence
  chemically synthesized
gaagatgctatactgcttgctt

SEQ ID NO: 1399703 - DNA, 22 bp, Artificial Sequence
  chemically synthesized
ctccattttcaaagcaagcagt

SEQ ID NO: 1399704 - DNA, 22 bp, Artificial Sequence
  chemically synthesized
cattttcaaagcaagcagtata

SEQ ID NO: 1399705 - DNA, 22 bp, Artificial Sequence
  chemically synthesized
tcaaagcaagcagtatagcatc

SEQ ID NO: 1399706 - DNA, 22 bp, Artificial Sequence
  chemically synthesized
caaagcaagcagtatagcatct

SEQ ID NO: 1399707 - DNA, 22 bp, Artificial Sequence
  chemically synthesized
aaagcaagcagtatagcatctt

SEQ ID NO: 1399708 - DNA, 22 bp, Artificial Sequence
  chemically synthesized
ccagtctacatcacattactct

SEQ ID NO: 1399709 - DNA, 22 bp, Artificial Sequence
  chemically synthesized
cagtctacatcacattactctg

SEQ ID NO: 1399710 - DNA, 22 bp, Artificial Sequence
  chemically synthesized
gaatgaaaagcagtgtgtcaga

SEQ ID NO: 1399711 - DNA, 22 bp, Artificial Sequence
  chemically synthesized
catcacattactctgacacact

SEQ ID NO: 1399712 - DNA, 22 bp, Artificial Sequence
  chemically synthesized
ctctgacacactgcttttcatt

SEQ ID NO: 1399713 - DNA, 22 bp, Artificial Sequence
  chemically synthesized
tgacacactgcttttcattcca

SEQ ID NO: 1399714 - DNA, 22 bp, Artificial Sequence
  chemically synthesized
acacactgcttttcattccaac

SEQ ID NO: 1399715 - DNA, 22 bp, Artificial Sequence
  chemically synthesized
aaggagtcaaaggagatgttgg

SEQ ID NO: 1399716 - DNA, 22 bp, Artificial Sequence
  chemically synthesized
caaggagtcaaaggagatgttg

SEQ ID NO: 1399717 - DNA, 22 bp, Artificial Sequence
  chemically synthesized
cttttcattccaacatctcctt

SEQ ID NO: 1399718 - DNA, 22 bp, Artificial Sequence
  chemically synthesized
ttcattccaacatctcctttga

SEQ ID NO: 1399719 - DNA, 22 bp, Artificial Sequence
  chemically synthesized
tcattccaacatctcctttgac

SEQ ID NO: 1399720 - DNA, 22 bp, Artificial Sequence
  chemically synthesized
cattccaacatctcctttgact

SEQ ID NO: 1399721 - DNA, 22 bp, Artificial Sequence
  chemically synthesized
attccaacatctcctttgactc

SEQ ID NO: 1399722 - DNA, 22 bp, Artificial Sequence
  chemically synthesized
caacatctcctttgactccttg

SEQ ID NO: 1399723 - DNA, 22 bp, Artificial Sequence
  chemically synthesized
ctttgactccttgaaggatttt

SEQ ID NO: 1399724 - DNA, 22 bp, Artificial Sequence
  chemically synthesized
tgactccttgaaggattttttt

SEQ ID NO: 1399725 - DNA, 22 bp, Artificial Sequence
  chemically synthesized
gactccttgaaggatttttttc

SEQ ID NO: 1399726 - DNA, 22 bp, Artificial Sequence
  chemically synthesized
actccttgaaggatttttttct

SEQ ID NO: 1399727 - DNA, 22 bp, Artificial Sequence
  chemically synthesized
cttgaaggatttttttcttcct

SEQ ID NO: 1399728 - DNA, 22 bp, Artificial Sequence
  chemically synthesized
cgtatcaaaaaaaaggaagaaa

SEQ ID NO: 1399729 - DNA, 22 bp, Artificial Sequence
  chemically synthesized
gaaggatttttttcttcctttt

SEQ ID NO: 1399730 - DNA, 22 bp, Artificial Sequence
  chemically synthesized
aaggatttttttcttccttttt

SEQ ID NO: 1399731 - DNA, 22 bp, Artificial Sequence
  chemically synthesized
ttttcttccttttttttgatac

SEQ ID NO: 1399732 - DNA, 22 bp, Artificial Sequence
  chemically synthesized
tttcttccttttttttgatacg

SEQ ID NO: 1399733 - DNA, 22 bp, Artificial Sequence
  chemically synthesized
ttcttccttttttttgatacgg

SEQ ID NO: 1399734 - DNA, 22 bp, Artificial Sequence
  chemically synthesized
tcttccttttttttgatacgga

SEQ ID NO: 1399735 - DNA, 22 bp, Artificial Sequence
  chemically synthesized
cttccttttttttgatacggag

SEQ ID NO: 1399736 - DNA, 22 bp, Artificial Sequence
  chemically synthesized
ttccttttttttgatacggagt

SEQ ID NO: 1399737 - DNA, 22 bp, Artificial Sequence
  chemically synthesized
ccttttttttgatacggagttt

SEQ ID NO: 1399738 - DNA, 22 bp, Artificial Sequence
  chemically synthesized
cttttttttgatacggagtttc

SEQ ID NO: 1399739 - DNA, 22 bp, Artificial Sequence
  chemically synthesized
ggcaacaagagtgaaactccgt

SEQ ID NO: 1399740 - DNA, 22 bp, Artificial Sequence
  chemically synthesized
ttttttgatacggagtttcact

SEQ ID NO: 1399741 - DNA, 22 bp, Artificial Sequence
  chemically synthesized
tttttgatacggagtttcactc

SEQ ID NO: 1399742 - DNA, 22 bp, Artificial Sequence
  chemically synthesized
ttttgatacggagtttcactct

SEQ ID NO: 1399743 - DNA, 22 bp, Artificial Sequence
  chemically synthesized
tttgatacggagtttcactctt

SEQ ID NO: 1399744 - DNA, 22 bp, Artificial Sequence
  chemically synthesized
ttgatacggagtttcactcttg

SEQ ID NO: 1399745 - DNA, 22 bp, Artificial Sequence
  chemically synthesized
cagcctgggcaacaagagtgaa

SEQ ID NO: 1399746 - DNA, 22 bp, Artificial Sequence
  chemically synthesized
tgatacggagtttcactcttgt

SEQ ID NO: 1399747 - DNA, 22 bp, Artificial Sequence
  chemically synthesized
gatacggagtttcactcttgtt

SEQ ID NO: 1399748 - DNA, 22 bp, Artificial Sequence
  chemically synthesized
atacggagtttcactcttgttg

SEQ ID NO: 1399749 - DNA, 22 bp, Artificial Sequence
  chemically synthesized
cactccagcctgggcaacaaga

SEQ ID NO: 1399750 - DNA, 22 bp, Artificial Sequence
  chemically synthesized
cactcttgttgcccaggctgga

SEQ ID NO: 1399751 - DNA, 22 bp, Artificial Sequence
  chemically synthesized
actcttgttgcccaggctggag

SEQ ID NO: 1399752 - DNA, 22 bp, Artificial Sequence
  chemically synthesized
ttgttgcccaggctggagtgca

SEQ ID NO: 1399753 - DNA, 22 bp, Artificial Sequence
  chemically synthesized
gttgcccaggctggagtgcaat

SEQ ID NO: 1399754 - DNA, 22 bp, Artificial Sequence
  chemically synthesized
ttgcccaggctggagtgcaatg

SEQ ID NO: 1399755 - DNA, 22 bp, Artificial Sequence
  chemically synthesized
cccaggctggagtgcaatggcg

SEQ ID NO: 1399756 - DNA, 22 bp, Artificial Sequence
  chemically synthesized
tagtgagccaagatcacgccat

SEQ ID NO: 1399757 - DNA, 22 bp, Artificial Sequence
  chemically synthesized
gagtgcaatggcgtgatcttgg

SEQ ID NO: 1399758 - DNA, 22 bp, Artificial Sequence
  chemically synthesized
aacccaggaggcggaagttgta

SEQ ID NO: 1399759 - DNA, 22 bp, Artificial Sequence
  chemically synthesized
gaacccaggaggcggaagttgt

SEQ ID NO: 1399760 - DNA, 22 bp, Artificial Sequence
  chemically synthesized
cttgaacccaggaggcggaagt

SEQ ID NO: 1399761 - DNA, 22 bp, Artificial Sequence
  chemically synthesized
ggctcactacaacttccgcctc

SEQ ID NO: 1399762 - DNA, 22 bp, Artificial Sequence
  chemically synthesized
gctcactacaacttccgcctcc

SEQ ID NO: 1399763 - DNA, 22 bp, Artificial Sequence
  chemically synthesized
actacaacttccgcctcctggg

SEQ ID NO: 1399764 - DNA, 22 bp, Artificial Sequence
  chemically synthesized
caacttccgcctcctgggttca

SEQ ID NO: 1399765 - DNA, 22 bp, Artificial Sequence
  chemically synthesized
aggcaggagaattgcttgaacc

SEQ ID NO: 1399766 - DNA, 22 bp, Artificial Sequence
  chemically synthesized
ccgcctcctgggttcaagcaat

SEQ ID NO: 1399767 - DNA, 22 bp, Artificial Sequence
  chemically synthesized
cgcctcctgggttcaagcaatt

SEQ ID NO: 1399768 - DNA, 22 bp, Artificial Sequence
  chemically synthesized
ggaggctgaggcaggagaattg

SEQ ID NO: 1399769 - DNA, 22 bp, Artificial Sequence
  chemically synthesized
ctgggttcaagcaattctcctg

SEQ ID NO: 1399770 - DNA, 22 bp, Artificial Sequence
  chemically synthesized
gggaggctgaggcaggagaatt

SEQ ID NO: 1399771 - DNA, 22 bp, Artificial Sequence
  chemically synthesized
ggttcaagcaattctcctgcct

SEQ ID NO: 1399772 - DNA, 22 bp, Artificial Sequence
  chemically synthesized
cttgggaggctgaggcaggaga

SEQ ID NO: 1399773 - DNA, 22 bp, Artificial Sequence
  chemically synthesized
aagcaattctcctgcctcagcc

SEQ ID NO: 1399774 - DNA, 22 bp, Artificial Sequence
  chemically synthesized
taatcccagctacttgggaggc

SEQ ID NO: 1399775 - DNA, 22 bp, Artificial Sequence
  chemically synthesized
tcctgcctcagcctcccaagta

SEQ ID NO: 1399776 - DNA, 22 bp, Artificial Sequence
  chemically synthesized
ctgcctcagcctcccaagtagc

SEQ ID NO: 1399777 - DNA, 22 bp, Artificial Sequence
  chemically synthesized
cctcagcctcccaagtagctgg

SEQ ID NO: 1399778 - DNA, 22 bp, Artificial Sequence
  chemically synthesized
agcctcccaagtagctgggatt

SEQ ID NO: 1399779 - DNA, 22 bp, Artificial Sequence
  chemically synthesized
ccaagtagctgggattacaggc

SEQ ID NO: 1399780 - DNA, 22 bp, Artificial Sequence
  chemically synthesized
gccaggcatggtggtgcatgcc

SEQ ID NO: 1399781 - DNA, 22 bp, Artificial Sequence
  chemically synthesized
ggattacaggcatgcaccacca

SEQ ID NO: 1399782 - DNA, 22 bp, Artificial Sequence
  chemically synthesized
caggcatgcaccaccatgcctg

SEQ ID NO: 1399783 - DNA, 22 bp, Artificial Sequence
  chemically synthesized
caaaatacaaaattagccaggc

SEQ ID NO: 1399784 - DNA, 22 bp, Artificial Sequence
  chemically synthesized
ctacaaaatacaaaattagcca

SEQ ID NO: 1399785 - DNA, 22 bp, Artificial Sequence
  chemically synthesized
tactacaaaatacaaaattagc

SEQ ID NO: 1399786 - DNA, 22 bp, Artificial Sequence
  chemically synthesized
tctactacaaaatacaaaatta

SEQ ID NO: 1399787 - DNA, 22 bp, Artificial Sequence
  chemically synthesized
ctctactacaaaatacaaaatt

SEQ ID NO: 1399788 - DNA, 22 bp, Artificial Sequence
  chemically synthesized
gctaattttgtattttgtagta

SEQ ID NO: 1399789 - DNA, 22 bp, Artificial Sequence
  chemically synthesized
attttgtattttgtagtagaga

SEQ ID NO: 1399790 - DNA, 22 bp, Artificial Sequence
  chemically synthesized
tgtattttgtagtagagaaggg

SEQ ID NO: 1399791 - DNA, 22 bp, Artificial Sequence
  chemically synthesized
gtattttgtagtagagaagggg

SEQ ID NO: 1399792 - DNA, 22 bp, Artificial Sequence
  chemically synthesized
tattttgtagtagagaaggggt

SEQ ID NO: 1399793 - DNA, 22 bp, Artificial Sequence
  chemically synthesized
gccaacatggtgaaaccccttc

SEQ ID NO: 1399794 - DNA, 22 bp, Artificial Sequence
  chemically synthesized
ggccaacatggtgaaacccctt

SEQ ID NO: 1399795 - DNA, 22 bp, Artificial Sequence
  chemically synthesized
tgtagtagagaaggggtttcac

SEQ ID NO: 1399796 - DNA, 22 bp, Artificial Sequence
  chemically synthesized
gtagtagagaaggggtttcacc

SEQ ID NO: 1399797 - DNA, 22 bp, Artificial Sequence
  chemically synthesized
tagtagagaaggggtttcacca

SEQ ID NO: 1399798 - DNA, 22 bp, Artificial Sequence
  chemically synthesized
aagaccagcttggccaacatgg

SEQ ID NO: 1399799 - DNA, 22 bp, Artificial Sequence
  chemically synthesized
caccatgttggccaagctggtc

SEQ ID NO: 1399800 - DNA, 22 bp, Artificial Sequence
  chemically synthesized
accatgttggccaagctggtct

SEQ ID NO: 1399801 - DNA, 22 bp, Artificial Sequence
  chemically synthesized
aggtcaggagttcaagaccagc

SEQ ID NO: 1399802 - DNA, 22 bp, Artificial Sequence
  chemically synthesized
gccaagctggtcttgaactcct

SEQ ID NO: 1399803 - DNA, 22 bp, Artificial Sequence
  chemically synthesized
gtcttgaactcctgacctcagg

SEQ ID NO: 1399804 - DNA, 22 bp, Artificial Sequence
  chemically synthesized
aggcgggtggatcacctgaggt

SEQ ID NO: 1399805 - DNA, 22 bp, Artificial Sequence
  chemically synthesized
gaactcctgacctcaggtgatc

SEQ ID NO: 1399806 - DNA, 22 bp, Artificial Sequence
  chemically synthesized
aactcctgacctcaggtgatcc

SEQ ID NO: 1399807 - DNA, 22 bp, Artificial Sequence
  chemically synthesized
ggaggctgaggcgggtggatca

SEQ ID NO: 1399808 - DNA, 22 bp, Artificial Sequence
  chemically synthesized
ctgacctcaggtgatccacccg

SEQ ID NO: 1399809 - DNA, 22 bp, Artificial Sequence
  chemically synthesized
gggaggctgaggcgggtggatc

SEQ ID NO: 1399810 - DNA, 22 bp, Artificial Sequence
  chemically synthesized
tgggaggctgaggcgggtggat

SEQ ID NO: 1399811 - DNA, 22 bp, Artificial Sequence
  chemically synthesized
acctcaggtgatccacccgcct

SEQ ID NO: 1399812 - DNA, 22 bp, Artificial Sequence
  chemically synthesized
aggtgatccacccgcctcagcc

SEQ ID NO: 1399813 - DNA, 22 bp, Artificial Sequence
  chemically synthesized
taatcccagcactttgggaggc

SEQ ID NO: 1399814 - DNA, 22 bp, Artificial Sequence
  chemically synthesized
atgcctgtaatcccagcacttt

SEQ ID NO: 1399815 - DNA, 22 bp, Artificial Sequence
  chemically synthesized
agcctcccaaagtgctgggatt

SEQ ID NO: 1399816 - DNA, 22 bp, Artificial Sequence
  chemically synthesized
ccaaagtgctgggattacaggc

SEQ ID NO: 1399817 - DNA, 22 bp, Artificial Sequence
  chemically synthesized
ggtgcggtggctcatgcctgta

SEQ ID NO: 1399818 - DNA, 22 bp, Artificial Sequence
  chemically synthesized
ggattacaggcatgagccaccg

SEQ ID NO: 1399819 - DNA, 22 bp, Artificial Sequence
  chemically synthesized
aaggtggctaggtgcggtggct

SEQ ID NO: 1399820 - DNA, 22 bp, Artificial Sequence
  chemically synthesized
caaggtggctaggtgcggtggc

SEQ ID NO: 1399821 - DNA, 22 bp, Artificial Sequence
  chemically synthesized
caggcatgagccaccgcaccta

SEQ ID NO: 1399822 - DNA, 22 bp, Artificial Sequence
  chemically synthesized
gccaccttgaaggatctttgtg

SEQ ID NO: 1399823 - DNA, 22 bp, Artificial Sequence
  chemically synthesized
aaaataagcacaaacacacaaa

SEQ ID NO: 1399824 - DNA, 22 bp, Artificial Sequence
  chemically synthesized
gaaggatctttgtgtgtttgtg

SEQ ID NO: 1399825 - DNA, 22 bp, Artificial Sequence
  chemically synthesized
aaggatctttgtgtgtttgtgc

SEQ ID NO: 1399826 - DNA, 22 bp, Artificial Sequence
  chemically synthesized
tgtgtgtttgtgcttattttta

SEQ ID NO: 1399827 - DNA, 22 bp, Artificial Sequence
  chemically synthesized
gtgtgtttgtgcttatttttaa

SEQ ID NO: 1399828 - DNA, 22 bp, Artificial Sequence
  chemically synthesized
tgtgtttgtgcttatttttaat

SEQ ID NO: 1399829 - DNA, 22 bp, Artificial Sequence
  chemically synthesized
tgtggatggaaccaattaaaaa

SEQ ID NO: 1399830 - DNA, 22 bp, Artificial Sequence
  chemically synthesized
gtgcttatttttaattggttcc

SEQ ID NO: 1399831 - DNA, 22 bp, Artificial Sequence
  chemically synthesized
gattatgtggatggaaccaatt

SEQ ID NO: 1399832 - DNA, 22 bp, Artificial Sequence
  chemically synthesized
tgcttatttttaattggttcca

SEQ ID NO: 1399833 - DNA, 22 bp, Artificial Sequence
  chemically synthesized
tcctggattatgtggatggaac

SEQ ID NO: 1399834 - DNA, 22 bp, Artificial Sequence
  chemically synthesized
atttttaattggttccatccac

SEQ ID NO: 1399835 - DNA, 22 bp, Artificial Sequence
  chemically synthesized
tttttaattggttccatccaca

SEQ ID NO: 1399836 - DNA, 22 bp, Artificial Sequence
  chemically synthesized
ttaattggttccatccacataa

SEQ ID NO: 1399837 - DNA, 22 bp, Artificial Sequence
  chemically synthesized
taattggttccatccacataat

SEQ ID NO: 1399838 - DNA, 22 bp, Artificial Sequence
  chemically synthesized
aattggttccatccacataatc

SEQ ID NO: 1399839 - DNA, 22 bp, Artificial Sequence
  chemically synthesized
attggttccatccacataatcc

SEQ ID NO: 1399840 - DNA, 22 bp, Artificial Sequence
  chemically synthesized
gttccatccacataatccagga

SEQ ID NO: 1399841 - DNA, 22 bp, Artificial Sequence
  chemically synthesized
agatggtaagattatcctggat

SEQ ID NO: 1399842 - DNA, 22 bp, Artificial Sequence
  chemically synthesized
gagatggtaagattatcctgga

SEQ ID NO: 1399843 - DNA, 22 bp, Artificial Sequence
  chemically synthesized
catccacataatccaggataat

SEQ ID NO: 1399844 - DNA, 22 bp, Artificial Sequence
  chemically synthesized
tgagatggtaagattatcctgg

SEQ ID NO: 1399845 - DNA, 22 bp, Artificial Sequence
  chemically synthesized
gggactttgagatggtaagatt

SEQ ID NO: 1399846 - DNA, 22 bp, Artificial Sequence
  chemically synthesized
aattagggactttgagatggta

SEQ ID NO: 1399847 - DNA, 22 bp, Artificial Sequence
  chemically synthesized
attaaattagggactttgagat

SEQ ID NO: 1399848 - DNA, 22 bp, Artificial Sequence
  chemically synthesized
gattaaattagggactttgaga

SEQ ID NO: 1399849 - DNA, 22 bp, Artificial Sequence
  chemically synthesized
cagatttgattaaattagggac

SEQ ID NO: 1399850 - DNA, 22 bp, Artificial Sequence
  chemically synthesized
accatctcaaagtccctaattt

SEQ ID NO: 1399851 - DNA, 22 bp, Artificial Sequence
  chemically synthesized
gcagatttgattaaattaggga

SEQ ID NO: 1399852 - DNA, 22 bp, Artificial Sequence
  chemically synthesized
ccatctcaaagtccctaattta

SEQ ID NO: 1399853 - DNA, 22 bp, Artificial Sequence
  chemically synthesized
tgcagatttgattaaattaggg

SEQ ID NO: 1399854 - DNA, 22 bp, Artificial Sequence
  chemically synthesized
ctttgcagatttgattaaatta

SEQ ID NO: 1399855 - DNA, 22 bp, Artificial Sequence
  chemically synthesized
actttgcagatttgattaaatt

SEQ ID NO: 1399856 - DNA, 22 bp, Artificial Sequence
  chemically synthesized
aaagtccctaatttaatcaaat

SEQ ID NO: 1399857 - DNA, 22 bp, Artificial Sequence
  chemically synthesized
atttaatcaaatctgcaaagta

SEQ ID NO: 1399858 - DNA, 22 bp, Artificial Sequence
  chemically synthesized
aatcaaatctgcaaagtaaact

SEQ ID NO: 1399859 - DNA, 22 bp, Artificial Sequence
  chemically synthesized
atcaaatctgcaaagtaaactt

SEQ ID NO: 1399860 - DNA, 22 bp, Artificial Sequence
  chemically synthesized
ccataaaaaggcaaagtttact

SEQ ID NO: 1399861 - DNA, 22 bp, Artificial Sequence
  chemically synthesized
accataaaaaggcaaagtttac

SEQ ID NO: 1399862 - DNA, 22 bp, Artificial Sequence
  chemically synthesized
taccataaaaaggcaaagttta

SEQ ID NO: 1399863 - DNA, 22 bp, Artificial Sequence
  chemically synthesized
atattttaccataaaaaggcaa

SEQ ID NO: 1399864 - DNA, 22 bp, Artificial Sequence
  chemically synthesized
caaagtaaactttgccttttta

SEQ ID NO: 1399865 - DNA, 22 bp, Artificial Sequence
  chemically synthesized
agttaatattttaccataaaaa

SEQ ID NO: 1399866 - DNA, 22 bp, Artificial Sequence
  chemically synthesized
tgcctttttatggtaaaatatt

SEQ ID NO: 1399867 - DNA, 22 bp, Artificial Sequence
  chemically synthesized
gcctttttatggtaaaatatta

SEQ ID NO: 1399868 - DNA, 22 bp, Artificial Sequence
  chemically synthesized
cctttttatggtaaaatattaa

SEQ ID NO: 1399869 - DNA, 22 bp, Artificial Sequence
  chemically synthesized
tttatggtaaaatattaactta

SEQ ID NO: 1399870 - DNA, 22 bp, Artificial Sequence
  chemically synthesized
ttatggtaaaatattaacttaa

SEQ ID NO: 1399871 - DNA, 22 bp, Artificial Sequence
  chemically synthesized
tatggtaaaatattaacttaac

SEQ ID NO: 1399872 - DNA, 22 bp, Artificial Sequence
  chemically synthesized
atggtaaaatattaacttaacg

SEQ ID NO: 1399873 - DNA, 22 bp, Artificial Sequence
  chemically synthesized
tggtaaaatattaacttaacgg

SEQ ID NO: 1399874 - DNA, 22 bp, Artificial Sequence
  chemically synthesized
aacaacccagtcccgttaagtt

SEQ ID NO: 1399875 - DNA, 22 bp, Artificial Sequence
  chemically synthesized
gaacaacccagtcccgttaagt

SEQ ID NO: 1399876 - DNA, 22 bp, Artificial Sequence
  chemically synthesized
acttaacgggactgggttgttc

SEQ ID NO: 1399877 - DNA, 22 bp, Artificial Sequence
  chemically synthesized
gaatgtacagagtttgaacaac

SEQ ID NO: 1399878 - DNA, 22 bp, Artificial Sequence
  chemically synthesized
aacgggactgggttgttcaaac

SEQ ID NO: 1399879 - DNA, 22 bp, Artificial Sequence
  chemically synthesized
ggaatgtacagagtttgaacaa

SEQ ID NO: 1399880 - DNA, 22 bp, Artificial Sequence
  chemically synthesized
acgggactgggttgttcaaact

SEQ ID NO: 1399881 - DNA, 22 bp, Artificial Sequence
  chemically synthesized
tggaatgtacagagtttgaaca

SEQ ID NO: 1399882 - DNA, 22 bp, Artificial Sequence
  chemically synthesized
tttggaatgtacagagtttgaa

SEQ ID NO: 1399883 - DNA, 22 bp, Artificial Sequence
  chemically synthesized
ctttggaatgtacagagtttga

SEQ ID NO: 1399884 - DNA, 22 bp, Artificial Sequence
  chemically synthesized
ggttgttcaaactctgtacatt

SEQ ID NO: 1399885 - DNA, 22 bp, Artificial Sequence
  chemically synthesized
ttcaaactctgtacattccaaa

SEQ ID NO: 1399886 - DNA, 22 bp, Artificial Sequence
  chemically synthesized
aaactctgtacattccaaagaa

SEQ ID NO: 1399887 - DNA, 22 bp, Artificial Sequence
  chemically synthesized
tgtacattccaaagaaatatct

SEQ ID NO: 1399888 - DNA, 22 bp, Artificial Sequence
  chemically synthesized
tacattccaaagaaatatctgg

SEQ ID NO: 1399889 - DNA, 22 bp, Artificial Sequence
  chemically synthesized
caaagaaatatctggctcttga

SEQ ID NO: 1399890 - DNA, 22 bp, Artificial Sequence
  chemically synthesized
cccagaagccagtcaagagcca

SEQ ID NO: 1399891 - DNA, 22 bp, Artificial Sequence
  chemically synthesized
gtattgcccagaagccagtcaa

SEQ ID NO: 1399892 - DNA, 22 bp, Artificial Sequence
  chemically synthesized
tctggtattgcccagaagccag

SEQ ID NO: 1399893 - DNA, 22 bp, Artificial Sequence
  chemically synthesized
gctcttgactggcttctgggca

SEQ ID NO: 1399894 - DNA, 22 bp, Artificial Sequence
  chemically synthesized
ttgactggcttctgggcaatac

SEQ ID NO: 1399895 - DNA, 22 bp, Artificial Sequence
  chemically synthesized
gactggcttctgggcaatacca

SEQ ID NO: 1399896 - DNA, 22 bp, Artificial Sequence
  chemically synthesized
aaataaactatctggtattgcc

SEQ ID NO: 1399897 - DNA, 22 bp, Artificial Sequence
  chemically synthesized
actggcttctgggcaataccag

SEQ ID NO: 1399898 - DNA, 22 bp, Artificial Sequence
  chemically synthesized
ttaaaataaactatctggtatt

SEQ ID NO: 1399899 - DNA, 22 bp, Artificial Sequence
  chemically synthesized
gcttctgggcaataccagatag

SEQ ID NO: 1399900 - DNA, 22 bp, Artificial Sequence
  chemically synthesized
ctgggcaataccagatagttta

SEQ ID NO: 1399901 - DNA, 22 bp, Artificial Sequence
  chemically synthesized
tgggcaataccagatagtttat

SEQ ID NO: 1399902 - DNA, 22 bp, Artificial Sequence
  chemically synthesized
ggcaataccagatagtttattt

SEQ ID NO: 1399903 - DNA, 22 bp, Artificial Sequence
  chemically synthesized
caccatacattattaaaataaa

SEQ ID NO: 1399904 - DNA, 22 bp, Artificial Sequence
  chemically synthesized
aaagctgcaccatacattatta

SEQ ID NO: 1399905 - DNA, 22 bp, Artificial Sequence
  chemically synthesized
attttaataatgtatggtgcag

SEQ ID NO: 1399906 - DNA, 22 bp, Artificial Sequence
  chemically synthesized
ttttaataatgtatggtgcagc

SEQ ID NO: 1399907 - DNA, 22 bp, Artificial Sequence
  chemically synthesized
taataatgtatggtgcagcttt

SEQ ID NO: 1399908 - DNA, 22 bp, Artificial Sequence
  chemically synthesized
aataatgtatggtgcagctttt

SEQ ID NO: 1399909 - DNA, 22 bp, Artificial Sequence
  chemically synthesized
ataatgtatggtgcagctttta

SEQ ID NO: 1399910 - DNA, 22 bp, Artificial Sequence
  chemically synthesized
atacagtgtaacctaaaagctg

SEQ ID NO: 1399911 - DNA, 22 bp, Artificial Sequence
  chemically synthesized
aaactgatacagtgtaacctaa

SEQ ID NO: 1399912 - DNA, 22 bp, Artificial Sequence
  chemically synthesized
cagagttcaaactgatacagtg

SEQ ID NO: 1399913 - DNA, 22 bp, Artificial Sequence
  chemically synthesized
tccagagttcaaactgatacag

SEQ ID NO: 1399914 - DNA, 22 bp, Artificial Sequence
  chemically synthesized
ttaggttacactgtatcagttt

SEQ ID NO: 1399915 - DNA, 22 bp, Artificial Sequence
  chemically synthesized
taggttacactgtatcagtttg

SEQ ID NO: 1399916 - DNA, 22 bp, Artificial Sequence
  chemically synthesized
aggttacactgtatcagtttga

SEQ ID NO: 1399917 - DNA, 22 bp, Artificial Sequence
  chemically synthesized
ggttacactgtatcagtttgaa

SEQ ID NO: 1399918 - DNA, 22 bp, Artificial Sequence
  chemically synthesized
cagcctctccagagttcaaact

SEQ ID NO: 1399919 - DNA, 22 bp, Artificial Sequence
  chemically synthesized
cactgtatcagtttgaactctg

SEQ ID NO: 1399920 - DNA, 22 bp, Artificial Sequence
  chemically synthesized
tatcagtttgaactctggagag

SEQ ID NO: 1399921 - DNA, 22 bp, Artificial Sequence
  chemically synthesized
gtcatctccagcctctccagag

SEQ ID NO: 1399922 - DNA, 22 bp, Artificial Sequence
  chemically synthesized
agtcatctccagcctctccaga

SEQ ID NO: 1399923 - DNA, 22 bp, Artificial Sequence
  chemically synthesized
tagtcatctccagcctctccag

SEQ ID NO: 1399924 - DNA, 22 bp, Artificial Sequence
  chemically synthesized
actttagtcatctccagcctct

SEQ ID NO: 1399925 - DNA, 22 bp, Artificial Sequence
  chemically synthesized
gaactctggagaggctggagat

SEQ ID NO: 1399926 - DNA, 22 bp, Artificial Sequence
  chemically synthesized
aactctggagaggctggagatg

SEQ ID NO: 1399927 - DNA, 22 bp, Artificial Sequence
  chemically synthesized
tggagaggctggagatgactaa

SEQ ID NO: 1399928 - DNA, 22 bp, Artificial Sequence
  chemically synthesized
acatggctgactttagtcatct

SEQ ID NO: 1399929 - DNA, 22 bp, Artificial Sequence
  chemically synthesized
gagaggctggagatgactaaag

SEQ ID NO: 1399930 - DNA, 22 bp, Artificial Sequence
  chemically synthesized
gagatgactaaagtcagccatg

SEQ ID NO: 1399931 - DNA, 22 bp, Artificial Sequence
  chemically synthesized
tagtaggcatggaacactcaca

SEQ ID NO: 1399932 - DNA, 22 bp, Artificial Sequence
  chemically synthesized
gtagtaggcatggaacactcac

SEQ ID NO: 1399933 - DNA, 22 bp, Artificial Sequence
  chemically synthesized
aagtcagccatgtgagtgttcc

SEQ ID NO: 1399934 - DNA, 22 bp, Artificial Sequence
  chemically synthesized
gagtttgtagtaggcatggaac

SEQ ID NO: 1399935 - DNA, 22 bp, Artificial Sequence
  chemically synthesized
tattggagtttgtagtaggcat

SEQ ID NO: 1399936 - DNA, 22 bp, Artificial Sequence
  chemically synthesized
gaattgtattggagtttgtagt

SEQ ID NO: 1399937 - DNA, 22 bp, Artificial Sequence
  chemically synthesized
catgcctactacaaactccaat

SEQ ID NO: 1399938 - DNA, 22 bp, Artificial Sequence
  chemically synthesized
gtgtctagaattgtattggagt

SEQ ID NO: 1399939 - DNA, 22 bp, Artificial Sequence
  chemically synthesized
ggtgtctagaattgtattggag

SEQ ID NO: 1399940 - DNA, 22 bp, Artificial Sequence
  chemically synthesized
ctacaaactccaatacaattct

SEQ ID NO: 1399941 - DNA, 22 bp, Artificial Sequence
  chemically synthesized
agtcttggtgtctagaattgta

SEQ ID NO: 1399942 - DNA, 22 bp, Artificial Sequence
  chemically synthesized
caaactccaatacaattctaga

SEQ ID NO: 1399943 - DNA, 22 bp, Artificial Sequence
  chemically synthesized
cctaagtcttggtgtctagaat

SEQ ID NO: 1399944 - DNA, 22 bp, Artificial Sequence
  chemically synthesized
caatacaattctagacaccaag

SEQ ID NO: 1399945 - DNA, 22 bp, Artificial Sequence
  chemically synthesized
ccaacgaaaagttgcctaagtc

SEQ ID NO: 1399946 - DNA, 22 bp, Artificial Sequence
  chemically synthesized
tagacaccaagacttaggcaac

SEQ ID NO: 1399947 - DNA, 22 bp, Artificial Sequence
  chemically synthesized
gacaccaagacttaggcaactt

SEQ ID NO: 1399948 - DNA, 22 bp, Artificial Sequence
  chemically synthesized
aggcaacttttcgttggcaata

SEQ ID NO: 1399949 - DNA, 22 bp, Artificial Sequence
  chemically synthesized
ggcaacttttcgttggcaatac

SEQ ID NO: 1399950 - DNA, 22 bp, Artificial Sequence
  chemically synthesized
ttcgttggcaatacgatgtgtg

SEQ ID NO: 1399951 - DNA, 22 bp, Artificial Sequence
  chemically synthesized
tcgttggcaatacgatgtgtgt

SEQ ID NO: 1399952 - DNA, 22 bp, Artificial Sequence
  chemically synthesized
cgttggcaatacgatgtgtgtg

SEQ ID NO: 1399953 - DNA, 22 bp, Artificial Sequence
  chemically synthesized
gttggcaatacgatgtgtgtgt

SEQ ID NO: 1399954 - DNA, 22 bp, Artificial Sequence
  chemically synthesized
gcaatacgatgtgtgtgttgtc

SEQ ID NO: 1399955 - DNA, 22 bp, Artificial Sequence
  chemically synthesized
tcccaacagtgatgtgtgacaa

SEQ ID NO: 1399956 - DNA, 22 bp, Artificial Sequence
  chemically synthesized
attatcccaacagtgatgtgtg

SEQ ID NO: 1399957 - DNA, 22 bp, Artificial Sequence
  chemically synthesized
aattatcccaacagtgatgtgt

SEQ ID NO: 1399958 - DNA, 22 bp, Artificial Sequence
  chemically synthesized
tcacacatcactgttgggataa

SEQ ID NO: 1399959 - DNA, 22 bp, Artificial Sequence
  chemically synthesized
gacagcatttaattatcccaac

SEQ ID NO: 1399960 - DNA, 22 bp, Artificial Sequence
  chemically synthesized
ttgggataattaaatgctgtcc

SEQ ID NO: 1399961 - DNA, 22 bp, Artificial Sequence
  chemically synthesized
atgaagtcatctggacagcatt

SEQ ID NO: 1399962 - DNA, 22 bp, Artificial Sequence
  chemically synthesized
ggataattaaatgctgtccaga

SEQ ID NO: 1399963 - DNA, 22 bp, Artificial Sequence
  chemically synthesized
ctcatgaagtcatctggacagc

SEQ ID NO: 1399964 - DNA, 22 bp, Artificial Sequence
  chemically synthesized
tcctcatgaagtcatctggaca

SEQ ID NO: 1399965 - DNA, 22 bp, Artificial Sequence
  chemically synthesized
ctctcctcatgaagtcatctgg

SEQ ID NO: 1399966 - DNA, 22 bp, Artificial Sequence
  chemically synthesized
cctctcctcatgaagtcatctg

SEQ ID NO: 1399967 - DNA, 22 bp, Artificial Sequence
  chemically synthesized
tcctctcctcatgaagtcatct

SEQ ID NO: 1399968 - DNA, 22 bp, Artificial Sequence
  chemically synthesized
aatgctgtccagatgacttcat

SEQ ID NO: 1399969 - DNA, 22 bp, Artificial Sequence
  chemically synthesized
cagttttcctctcctcatgaag

SEQ ID NO: 1399970 - DNA, 22 bp, Artificial Sequence
  chemically synthesized
ccagttttcctctcctcatgaa

SEQ ID NO: 1399971 - DNA, 22 bp, Artificial Sequence
  chemically synthesized
tccagatgacttcatgaggaga

SEQ ID NO: 1399972 - DNA, 22 bp, Artificial Sequence
  chemically synthesized
catgaggagaggaaaactggaa

SEQ ID NO: 1399973 - DNA, 22 bp, Artificial Sequence
  chemically synthesized
atgaggagaggaaaactggaag

SEQ ID NO: 1399974 - DNA, 22 bp, Artificial Sequence
  chemically synthesized
aggaaagaccaggtgccacctt

SEQ ID NO: 1399975 - DNA, 22 bp, Artificial Sequence
  chemically synthesized
gaaggtggcacctggtctttcc

SEQ ID NO: 1399976 - DNA, 22 bp, Artificial Sequence
  chemically synthesized
catacaaccgggttcaggaaag

SEQ ID NO: 1399977 - DNA, 22 bp, Artificial Sequence
  chemically synthesized
gtctttcctgaacccggttgta

SEQ ID NO: 1399978 - DNA, 22 bp, Artificial Sequence
  chemically synthesized
tcctgaacccggttgtatgcaa

SEQ ID NO: 1399979 - DNA, 22 bp, Artificial Sequence
  chemically synthesized
cctgaacccggttgtatgcaac

SEQ ID NO: 1399980 - DNA, 22 bp, Artificial Sequence
  chemically synthesized
ctgaacccggttgtatgcaact

SEQ ID NO: 1399981 - DNA, 22 bp, Artificial Sequence
  chemically synthesized
aacccggttgtatgcaactttt

SEQ ID NO: 1399982 - DNA, 22 bp, Artificial Sequence
  chemically synthesized
aagtgaacaaagaaaaaagttg

SEQ ID NO: 1399983 - DNA, 22 bp, Artificial Sequence
  chemically synthesized
tatgcaacttttttctttgttc

SEQ ID NO: 1399984 - DNA, 22 bp, Artificial Sequence
  chemically synthesized
ttttctttgttcacttcagtct

SEQ ID NO: 1399985 - DNA, 22 bp, Artificial Sequence
  chemically synthesized
tttctttgttcacttcagtctt

SEQ ID NO: 1399986 - DNA, 22 bp, Artificial Sequence
  chemically synthesized
ttctttgttcacttcagtcttt

SEQ ID NO: 1399987 - DNA, 22 bp, Artificial Sequence
  chemically synthesized
caacaaaaagataaagactgaa

SEQ ID NO: 1399988 - DNA, 22 bp, Artificial Sequence
  chemically synthesized
tctttgttcacttcagtcttta

SEQ ID NO: 1399989 - DNA, 22 bp, Artificial Sequence
  chemically synthesized
ctttgttcacttcagtctttat

SEQ ID NO: 1399990 - DNA, 22 bp, Artificial Sequence
  chemically synthesized
tttgttcacttcagtctttatc

SEQ ID NO: 1399991 - DNA, 22 bp, Artificial Sequence
  chemically synthesized
ttacaacaaaaagataaagact

SEQ ID NO: 1399992 - DNA, 22 bp, Artificial Sequence
  chemically synthesized
attacaacaaaaagataaagac

SEQ ID NO: 1399993 - DNA, 22 bp, Artificial Sequence
  chemically synthesized
tgttcacttcagtctttatctt

SEQ ID NO: 1399994 - DNA, 22 bp, Artificial Sequence
  chemically synthesized
gttcacttcagtctttatcttt

SEQ ID NO: 1399995 - DNA, 22 bp, Artificial Sequence
  chemically synthesized
ttcacttcagtctttatctttt

SEQ ID NO: 1399996 - DNA, 22 bp, Artificial Sequence
  chemically synthesized
acttcagtctttatctttttgt

SEQ ID NO: 1399997 - DNA, 22 bp, Artificial Sequence
  chemically synthesized
cagtttattacaacaaaaagat

SEQ ID NO: 1399998 - DNA, 22 bp, Artificial Sequence
  chemically synthesized
cagtctttatctttttgttgta

SEQ ID NO: 1399999 - DNA, 22 bp, Artificial Sequence
  chemically synthesized
agtctttatctttttgttgtaa

SEQ ID NO: 1400000 - DNA, 22 bp, Artificial Sequence
  chemically synthesized
atgattacagtttattacaaca

SEQ ID NO: 1400001 - DNA, 22 bp, Artificial Sequence
  chemically synthesized
tatctttttgttgtaataaact

SEQ ID NO: 1400002 - DNA, 22 bp, Artificial Sequence
  chemically synthesized
atctttttgttgtaataaactg

SEQ ID NO: 1400003 - DNA, 22 bp, Artificial Sequence
  chemically synthesized
cactcatgattacagtttatta

SEQ ID NO: 1400004 - DNA, 22 bp, Artificial Sequence
  chemically synthesized
tctttttgttgtaataaactgt

SEQ ID NO: 1400005 - DNA, 22 bp, Artificial Sequence
  chemically synthesized
tttgttgtaataaactgtaatc

SEQ ID NO: 1400006 - DNA, 22 bp, Artificial Sequence
  chemically synthesized
ttgttgtaataaactgtaatca

SEQ ID NO: 1400007 - DNA, 22 bp, Artificial Sequence
  chemically synthesized
tgttgtaataaactgtaatcat

SEQ ID NO: 1400008 - DNA, 22 bp, Artificial Sequence
  chemically synthesized
gttgtaataaactgtaatcatg

SEQ ID NO: 1400009 - DNA, 22 bp, Artificial Sequence
  chemically synthesized
ttgtaataaactgtaatcatga

SEQ ID NO: 1400010 - DNA, 22 bp, Artificial Sequence
  chemically synthesized
aaagcagttacactcatgatta

SEQ ID NO: 1400011 - DNA, 22 bp, Artificial Sequence
  chemically synthesized
aaaagcagttacactcatgatt

SEQ ID NO: 1400012 - DNA, 22 bp, Artificial Sequence
  chemically synthesized
taataaactgtaatcatgagtg

SEQ ID NO: 1400013 - DNA, 22 bp, Artificial Sequence
  chemically synthesized
ttaaaagcagttacactcatga

SEQ ID NO: 1400014 - DNA, 22 bp, Artificial Sequence
  chemically synthesized
taatcatgagtgtaactgcttt

SEQ ID NO: 1400015 - DNA, 22 bp, Artificial Sequence
  chemically synthesized
atataattcttaaaagcagtta

SEQ ID NO: 1400016 - DNA, 22 bp, Artificial Sequence
  chemically synthesized
ggaggactcatataattcttaa

SEQ ID NO: 1400017 - DNA, 22 bp, Artificial Sequence
  chemically synthesized
aggaggactcatataattctta

SEQ ID NO: 1400018 - DNA, 22 bp, Artificial Sequence
  chemically synthesized
cttaggaggactcatataattc

SEQ ID NO: 1400019 - DNA, 22 bp, Artificial Sequence
  chemically synthesized
ttccttaggaggactcatataa

SEQ ID NO: 1400020 - DNA, 22 bp, Artificial Sequence
  chemically synthesized
cttttaagaattatatgagtcc

SEQ ID NO: 1400021 - DNA, 22 bp, Artificial Sequence
  chemically synthesized
ttaagaattatatgagtcctcc

SEQ ID NO: 1400022 - DNA, 22 bp, Artificial Sequence
  chemically synthesized
aattattccttaggaggactca

SEQ ID NO: 1400023 - DNA, 22 bp, Artificial Sequence
  chemically synthesized
taagaattatatgagtcctcct

SEQ ID NO: 1400024 - DNA, 22 bp, Artificial Sequence
  chemically synthesized
aagaattatatgagtcctccta

SEQ ID NO: 1400025 - DNA, 22 bp, Artificial Sequence
  chemically synthesized
agaattatatgagtcctcctaa

SEQ ID NO: 1400026 - DNA, 22 bp, Artificial Sequence
  chemically synthesized
aggttcaattattccttaggag

SEQ ID NO: 1400027 - DNA, 22 bp, Artificial Sequence
  chemically synthesized
tcaggttcaattattccttagg

SEQ ID NO: 1400028 - DNA, 22 bp, Artificial Sequence
  chemically synthesized
tatgagtcctcctaaggaataa

SEQ ID NO: 1400029 - DNA, 22 bp, Artificial Sequence
  chemically synthesized
ctctcaggttcaattattcctt

SEQ ID NO: 1400030 - DNA, 22 bp, Artificial Sequence
  chemically synthesized
aagtctactctcaggttcaatt

SEQ ID NO: 1400031 - DNA, 22 bp, Artificial Sequence
  chemically synthesized
ctaaggaataattgaacctgag

SEQ ID NO: 1400032 - DNA, 22 bp, Artificial Sequence
  chemically synthesized
aggaataattgaacctgagagt

SEQ ID NO: 1400033 - DNA, 22 bp, Artificial Sequence
  chemically synthesized
ggagtcctcaagtctactctca

SEQ ID NO: 1400034 - DNA, 22 bp, Artificial Sequence
  chemically synthesized
aggagtcctcaagtctactctc

SEQ ID NO: 1400035 - DNA, 22 bp, Artificial Sequence
  chemically synthesized
aacctgagagtagacttgagga

SEQ ID NO: 1400036 - DNA, 22 bp, Artificial Sequence
  chemically synthesized
agagtagacttgaggactccta

SEQ ID NO: 1400037 - DNA, 22 bp, Artificial Sequence
  chemically synthesized
tatggcgaaatttaggagtcct

SEQ ID NO: 1400038 - DNA, 22 bp, Artificial Sequence
  chemically synthesized
atatggcgaaatttaggagtcc

SEQ ID NO: 1400039 - DNA, 22 bp, Artificial Sequence
  chemically synthesized
ccttatatggcgaaatttagga

SEQ ID NO: 1400040 - DNA, 22 bp, Artificial Sequence
  chemically synthesized
gaggactcctaaatttcgccat

SEQ ID NO: 1400041 - DNA, 22 bp, Artificial Sequence
  chemically synthesized
aggactcctaaatttcgccata

SEQ ID NO: 1400042 - DNA, 22 bp, Artificial Sequence
  chemically synthesized
tgaatatgttgccttatatggc

SEQ ID NO: 1400043 - DNA, 22 bp, Artificial Sequence
  chemically synthesized
ctaaatttcgccatataaggca

SEQ ID NO: 1400044 - DNA, 22 bp, Artificial Sequence
  chemically synthesized
aatttcgccatataaggcaaca

SEQ ID NO: 1400045 - DNA, 22 bp, Artificial Sequence
  chemically synthesized
ggaagctatgaatatgttgcct

SEQ ID NO: 1400046 - DNA, 22 bp, Artificial Sequence
  chemically synthesized
aggaagctatgaatatgttgcc

SEQ ID NO: 1400047 - DNA, 22 bp, Artificial Sequence
  chemically synthesized
cgccatataaggcaacatattc

SEQ ID NO: 1400048 - DNA, 22 bp, Artificial Sequence
  chemically synthesized
gccatataaggcaacatattca

SEQ ID NO: 1400049 - DNA, 22 bp, Artificial Sequence
  chemically synthesized
atcttaggaagctatgaatatg

SEQ ID NO: 1400050 - DNA, 22 bp, Artificial Sequence
  chemically synthesized
taatcttaggaagctatgaata

SEQ ID NO: 1400051 - DNA, 22 bp, Artificial Sequence
  chemically synthesized
atagcttcctaagattagaaca

SEQ ID NO: 1400052 - DNA, 22 bp, Artificial Sequence
  chemically synthesized
cctaagattagaacatgtatgt

SEQ ID NO: 1400053 - DNA, 22 bp, Artificial Sequence
  chemically synthesized
ctaagattagaacatgtatgtc

SEQ ID NO: 1400054 - DNA, 22 bp, Artificial Sequence
  chemically synthesized
agattagaacatgtatgtcttt

SEQ ID NO: 1400055 - DNA, 22 bp, Artificial Sequence
  chemically synthesized
gaacatgtatgtctttggggga

SEQ ID NO: 1400056 - DNA, 22 bp, Artificial Sequence
  chemically synthesized
taggcatagtaatgatccccca

SEQ ID NO: 1400057 - DNA, 22 bp, Artificial Sequence
  chemically synthesized
ttgtaggcatagtaatgatccc

SEQ ID NO: 1400058 - DNA, 22 bp, Artificial Sequence
  chemically synthesized
tgtactgttgtaggcatagtaa

SEQ ID NO: 1400059 - DNA, 22 bp, Artificial Sequence
  chemically synthesized
atgtactgttgtaggcatagta

SEQ ID NO: 1400060 - DNA, 22 bp, Artificial Sequence
  chemically synthesized
tgggggatcattactatgccta

SEQ ID NO: 1400061 - DNA, 22 bp, Artificial Sequence
  chemically synthesized
tatgtactgttgtaggcatagt

SEQ ID NO: 1400062 - DNA, 22 bp, Artificial Sequence
  chemically synthesized
gggggatcattactatgcctac

SEQ ID NO: 1400063 - DNA, 22 bp, Artificial Sequence
  chemically synthesized
ggggatcattactatgcctaca

SEQ ID NO: 1400064 - DNA, 22 bp, Artificial Sequence
  chemically synthesized
ctatgcctacaacagtacataa

SEQ ID NO: 1400065 - DNA, 22 bp, Artificial Sequence
  chemically synthesized
tgcctacaacagtacataaaat

SEQ ID NO: 1400066 - DNA, 22 bp, Artificial Sequence
  chemically synthesized
cacaagagtcatgtattttatg

SEQ ID NO: 1400067 - DNA, 22 bp, Artificial Sequence
  chemically synthesized
tacacaagagtcatgtatttta

SEQ ID NO: 1400068 - DNA, 22 bp, Artificial Sequence
  chemically synthesized
ctacacaagagtcatgtatttt

SEQ ID NO: 1400069 - DNA, 22 bp, Artificial Sequence
  chemically synthesized
caacagtacataaaatacatga

SEQ ID NO: 1400070 - DNA, 22 bp, Artificial Sequence
  chemically synthesized
aagaagtttctacacaagagtc

SEQ ID NO: 1400071 - DNA, 22 bp, Artificial Sequence
  chemically synthesized
gtcaaataaattgaagaagttt

SEQ ID NO: 1400072 - DNA, 22 bp, Artificial Sequence
  chemically synthesized
tggtcaaataaattgaagaagt

SEQ ID NO: 1400073 - DNA, 22 bp, Artificial Sequence
  chemically synthesized
ttgtgtagaaacttcttcaatt

SEQ ID NO: 1400074 - DNA, 22 bp, Artificial Sequence
  chemically synthesized
gtgtagaaacttcttcaattta

SEQ ID NO: 1400075 - DNA, 22 bp, Artificial Sequence
  chemically synthesized
tgtagaaacttcttcaatttat

SEQ ID NO: 1400076 - DNA, 22 bp, Artificial Sequence
  chemically synthesized
gtcctctggtcaaataaattga

SEQ ID NO: 1400077 - DNA, 22 bp, Artificial Sequence
  chemically synthesized
cttcaatttatttgaccagagg

SEQ ID NO: 1400078 - DNA, 22 bp, Artificial Sequence
  chemically synthesized
ttcaatttatttgaccagagga

SEQ ID NO: 1400079 - DNA, 22 bp, Artificial Sequence
  chemically synthesized
aaaaaaaaactagtcctctggt

SEQ ID NO: 1400080 - DNA, 22 bp, Artificial Sequence
  chemically synthesized
caatttatttgaccagaggact

SEQ ID NO: 1400081 - DNA, 22 bp, Artificial Sequence
  chemically synthesized
aatttatttgaccagaggacta

SEQ ID NO: 1400082 - DNA, 22 bp, Artificial Sequence
  chemically synthesized
atttgaccagaggactagtttt

SEQ ID NO: 1400083 - DNA, 22 bp, Artificial Sequence
  chemically synthesized
tttgaccagaggactagttttt

SEQ ID NO: 1400084 - DNA, 22 bp, Artificial Sequence
  chemically synthesized
acaatattaaaaaaaaaactag

SEQ ID NO: 1400085 - DNA, 22 bp, Artificial Sequence
  chemically synthesized
gacaatattaaaaaaaaaacta

SEQ ID NO: 1400086 - DNA, 22 bp, Artificial Sequence
  chemically synthesized
gaccagaggactagtttttttt

SEQ ID NO: 1400087 - DNA, 22 bp, Artificial Sequence
  chemically synthesized
tgacaatattaaaaaaaaaact

SEQ ID NO: 1400088 - DNA, 22 bp, Artificial Sequence
  chemically synthesized
accagaggactagttttttttt

SEQ ID NO: 1400089 - DNA, 22 bp, Artificial Sequence
  chemically synthesized
ttgacaatattaaaaaaaaaac

SEQ ID NO: 1400090 - DNA, 22 bp, Artificial Sequence
  chemically synthesized
tttgacaatattaaaaaaaaaa

SEQ ID NO: 1400091 - DNA, 22 bp, Artificial Sequence
  chemically synthesized
ttttgacaatattaaaaaaaaa

SEQ ID NO: 1400092 - DNA, 22 bp, Artificial Sequence
  chemically synthesized
caagcttttttgacaatattaa

SEQ ID NO: 1400093 - DNA, 22 bp, Artificial Sequence
  chemically synthesized
ccaagcttttttgacaatatta

SEQ ID NO: 1400094 - DNA, 22 bp, Artificial Sequence
  chemically synthesized
gttttttttttaatattgtcaa

SEQ ID NO: 1400095 - DNA, 22 bp, Artificial Sequence
  chemically synthesized
tttttttaatattgtcaaaaaa

SEQ ID NO: 1400096 - DNA, 22 bp, Artificial Sequence
  chemically synthesized
ttttttaatattgtcaaaaaag

SEQ ID NO: 1400097 - DNA, 22 bp, Artificial Sequence
  chemically synthesized
tttttaatattgtcaaaaaagc

SEQ ID NO: 1400098 - DNA, 22 bp, Artificial Sequence
  chemically synthesized
ttttaatattgtcaaaaaagct

SEQ ID NO: 1400099 - DNA, 22 bp, Artificial Sequence
  chemically synthesized
tttaatattgtcaaaaaagctt

SEQ ID NO: 1400100 - DNA, 22 bp, Artificial Sequence
  chemically synthesized
ttaatattgtcaaaaaagcttg

SEQ ID NO: 1400101 - DNA, 22 bp, Artificial Sequence
  chemically synthesized
taatattgtcaaaaaagcttgg

SEQ ID NO: 1400102 - DNA, 22 bp, Artificial Sequence
  chemically synthesized
aatattgtcaaaaaagcttgga

SEQ ID NO: 1400103 - DNA, 22 bp, Artificial Sequence
  chemically synthesized
atattgtcaaaaaagcttggaa

SEQ ID NO: 1400104 - DNA, 22 bp, Artificial Sequence
  chemically synthesized
aataaaggaacatatgtttcca

SEQ ID NO: 1400105 - DNA, 22 bp, Artificial Sequence
  chemically synthesized
tcaaaaaagcttggaaacatat

SEQ ID NO: 1400106 - DNA, 22 bp, Artificial Sequence
  chemically synthesized
actcaataaaggaacatatgtt

SEQ ID NO: 1400107 - DNA, 22 bp, Artificial Sequence
  chemically synthesized
gactcaataaaggaacatatgt

SEQ ID NO: 1400108 - DNA, 22 bp, Artificial Sequence
  chemically synthesized
aatcttgactcaataaaggaac

SEQ ID NO: 1400109 - DNA, 22 bp, Artificial Sequence
  chemically synthesized
ggaaacatatgttcctttattg

SEQ ID NO: 1400110 - DNA, 22 bp, Artificial Sequence
  chemically synthesized
gaaacatatgttcctttattga

SEQ ID NO: 1400111 - DNA, 22 bp, Artificial Sequence
  chemically synthesized
agaaaactgaatcttgactcaa

SEQ ID NO: 1400112 - DNA, 22 bp, Artificial Sequence
  chemically synthesized
aagaaaactgaatcttgactca

SEQ ID NO: 1400113 - DNA, 22 bp, Artificial Sequence
  chemically synthesized
ttaagaaaactgaatcttgact

SEQ ID NO: 1400114 - DNA, 22 bp, Artificial Sequence
  chemically synthesized
ctttattgagtcaagattcagt

SEQ ID NO: 1400115 - DNA, 22 bp, Artificial Sequence
  chemically synthesized
tattgagtcaagattcagtttt

SEQ ID NO: 1400116 - DNA, 22 bp, Artificial Sequence
  chemically synthesized
attgagtcaagattcagttttc

SEQ ID NO: 1400117 - DNA, 22 bp, Artificial Sequence
  chemically synthesized
ttgagtcaagattcagttttct

SEQ ID NO: 1400118 - DNA, 22 bp, Artificial Sequence
  chemically synthesized
ataaaaatctcttaagaaaact

SEQ ID NO: 1400119 - DNA, 22 bp, Artificial Sequence
  chemically synthesized
agtcaagattcagttttcttaa

SEQ ID NO: 1400120 - DNA, 22 bp, Artificial Sequence
  chemically synthesized
gataaaaatctcttaagaaaac

SEQ ID NO: 1400121 - DNA, 22 bp, Artificial Sequence
  chemically synthesized
caaaacatttgataaaaatctc

SEQ ID NO: 1400122 - DNA, 22 bp, Artificial Sequence
  chemically synthesized
agttttcttaagagatttttat

SEQ ID NO: 1400123 - DNA, 22 bp, Artificial Sequence
  chemically synthesized
tcttaagagatttttatcaaat

SEQ ID NO: 1400124 - DNA, 22 bp, Artificial Sequence
  chemically synthesized
cttaagagatttttatcaaatg

SEQ ID NO: 1400125 - DNA, 22 bp, Artificial Sequence
  chemically synthesized
ttaagagatttttatcaaatgt

SEQ ID NO: 1400126 - DNA, 22 bp, Artificial Sequence
  chemically synthesized
aagagatttttatcaaatgttt

SEQ ID NO: 1400127 - DNA, 22 bp, Artificial Sequence
  chemically synthesized
agagatttttatcaaatgtttt

SEQ ID NO: 1400128 - DNA, 22 bp, Artificial Sequence
  chemically synthesized
aagaggtatattgcaaaacatt

SEQ ID NO: 1400129 - DNA, 22 bp, Artificial Sequence
  chemically synthesized
caagaggtatattgcaaaacat

SEQ ID NO: 1400130 - DNA, 22 bp, Artificial Sequence
  chemically synthesized
tcaagaggtatattgcaaaaca

SEQ ID NO: 1400131 - DNA, 22 bp, Artificial Sequence
  chemically synthesized
ttatcaaatgttttgcaatata

SEQ ID NO: 1400132 - DNA, 22 bp, Artificial Sequence
  chemically synthesized
tatcaaatgttttgcaatatac

SEQ ID NO: 1400133 - DNA, 22 bp, Artificial Sequence
  chemically synthesized
atcaaatgttttgcaatatacc

SEQ ID NO: 1400134 - DNA, 22 bp, Artificial Sequence
  chemically synthesized
tcaaatgttttgcaatatacct

SEQ ID NO: 1400135 - DNA, 22 bp, Artificial Sequence
  chemically synthesized
tgcaatatacctcttgaaaact

SEQ ID NO: 1400136 - DNA, 22 bp, Artificial Sequence
  chemically synthesized
gcaatatacctcttgaaaacta

SEQ ID NO: 1400137 - DNA, 22 bp, Artificial Sequence
  chemically synthesized
caatatacctcttgaaaactac

SEQ ID NO: 1400138 - DNA, 22 bp, Artificial Sequence
  chemically synthesized
catataggaaagggtagttttc

SEQ ID NO: 1400139 - DNA, 22 bp, Artificial Sequence
  chemically synthesized
tacatataggaaagggtagttt

SEQ ID NO: 1400140 - DNA, 22 bp, Artificial Sequence
  chemically synthesized
ttctacatataggaaagggtag

SEQ ID NO: 1400141 - DNA, 22 bp, Artificial Sequence
  chemically synthesized
attctacatataggaaagggta

SEQ ID NO: 1400142 - DNA, 22 bp, Artificial Sequence
  chemically synthesized
tattctacatataggaaagggt

SEQ ID NO: 1400143 - DNA, 22 bp, Artificial Sequence
  chemically synthesized
ttattctacatataggaaaggg

SEQ ID NO: 1400144 - DNA, 22 bp, Artificial Sequence
  chemically synthesized
ttgaaaactaccctttcctata

SEQ ID NO: 1400145 - DNA, 22 bp, Artificial Sequence
  chemically synthesized
gaaaactaccctttcctatatg

SEQ ID NO: 1400146 - DNA, 22 bp, Artificial Sequence
  chemically synthesized
atttttattctacatataggaa

SEQ ID NO: 1400147 - DNA, 22 bp, Artificial Sequence
  chemically synthesized
aaaactaccctttcctatatgt

SEQ ID NO: 1400148 - DNA, 22 bp, Artificial Sequence
  chemically synthesized
aatttttattctacatatagga

SEQ ID NO: 1400149 - DNA, 22 bp, Artificial Sequence
  chemically synthesized
taatttttattctacatatagg

SEQ ID NO: 1400150 - DNA, 22 bp, Artificial Sequence
  chemically synthesized
ttaatttttattctacatatag

SEQ ID NO: 1400151 - DNA, 22 bp, Artificial Sequence
  chemically synthesized
ccctttcctatatgtagaataa

SEQ ID NO: 1400152 - DNA, 22 bp, Artificial Sequence
  chemically synthesized
tgcttttaatttttattctaca

SEQ ID NO: 1400153 - DNA, 22 bp, Artificial Sequence
  chemically synthesized
attgtgcttttaatttttattc

SEQ ID NO: 1400154 - DNA, 22 bp, Artificial Sequence
  chemically synthesized
tcctatatgtagaataaaaatt

SEQ ID NO: 1400155 - DNA, 22 bp, Artificial Sequence
  chemically synthesized
aattgtgcttttaatttttatt

SEQ ID NO: 1400156 - DNA, 22 bp, Artificial Sequence
  chemically synthesized
cctatatgtagaataaaaatta

SEQ ID NO: 1400157 - DNA, 22 bp, Artificial Sequence
  chemically synthesized
taattgtgcttttaatttttat

SEQ ID NO: 1400158 - DNA, 22 bp, Artificial Sequence
  chemically synthesized
ctatatgtagaataaaaattaa

SEQ ID NO: 1400159 - DNA, 22 bp, Artificial Sequence
  chemically synthesized
ttaattgtgcttttaattttta

SEQ ID NO: 1400160 - DNA, 22 bp, Artificial Sequence
  chemically synthesized
tatgtagaataaaaattaaaag

SEQ ID NO: 1400161 - DNA, 22 bp, Artificial Sequence
  chemically synthesized
cttttaattgtgcttttaattt

SEQ ID NO: 1400162 - DNA, 22 bp, Artificial Sequence
  chemically synthesized
gcttttaattgtgcttttaatt

SEQ ID NO: 1400163 - DNA, 22 bp, Artificial Sequence
  chemically synthesized
tgcttttaattgtgcttttaat

SEQ ID NO: 1400164 - DNA, 22 bp, Artificial Sequence
  chemically synthesized
ttgcttttaattgtgcttttaa

SEQ ID NO: 1400165 - DNA, 22 bp, Artificial Sequence
  chemically synthesized
aaagcacaattaaaagcaaaaa

SEQ ID NO: 1400166 - DNA, 22 bp, Artificial Sequence
  chemically synthesized
aaagcaaaaacctgtcatatta

SEQ ID NO: 1400167 - DNA, 22 bp, Artificial Sequence
  chemically synthesized
gataacaaacatggaaagtaat

SEQ ID NO: 1400168 - DNA, 22 bp, Artificial Sequence
  chemically synthesized
ctagataacaaacatggaaagt

SEQ ID NO: 1400169 - DNA, 22 bp, Artificial Sequence
  chemically synthesized
actagataacaaacatggaaag

SEQ ID NO: 1400170 - DNA, 22 bp, Artificial Sequence
  chemically synthesized
tcatattactttccatgtttgt

SEQ ID NO: 1400171 - DNA, 22 bp, Artificial Sequence
  chemically synthesized
cagagtcatttactagataaca

SEQ ID NO: 1400172 - DNA, 22 bp, Artificial Sequence
  chemically synthesized
ctttccatgtttgttatctagt

SEQ ID NO: 1400173 - DNA, 22 bp, Artificial Sequence
  chemically synthesized
tccatgtttgttatctagtaaa

SEQ ID NO: 1400174 - DNA, 22 bp, Artificial Sequence
  chemically synthesized
attacagagtcatttactagat

SEQ ID NO: 1400175 - DNA, 22 bp, Artificial Sequence
  chemically synthesized
ccatgtttgttatctagtaaat

SEQ ID NO: 1400176 - DNA, 22 bp, Artificial Sequence
  chemically synthesized
catgtttgttatctagtaaatg

SEQ ID NO: 1400177 - DNA, 22 bp, Artificial Sequence
  chemically synthesized
gttatctagtaaatgactctgt

SEQ ID NO: 1400178 - DNA, 22 bp, Artificial Sequence
  chemically synthesized
ttatctagtaaatgactctgta

SEQ ID NO: 1400179 - DNA, 22 bp, Artificial Sequence
  chemically synthesized
ggaaatagttgattacagagtc

SEQ ID NO: 1400180 - DNA, 22 bp, Artificial Sequence
  chemically synthesized
tctagtaaatgactctgtaatc

SEQ ID NO: 1400181 - DNA, 22 bp, Artificial Sequence
  chemically synthesized
ctaggaaatagttgattacaga

SEQ ID NO: 1400182 - DNA, 22 bp, Artificial Sequence
  chemically synthesized
gtaaatgactctgtaatcaact

SEQ ID NO: 1400183 - DNA, 22 bp, Artificial Sequence
  chemically synthesized
ttgctaggaaatagttgattac

SEQ ID NO: 1400184 - DNA, 22 bp, Artificial Sequence
  chemically synthesized
attgctaggaaatagttgatta

SEQ ID NO: 1400185 - DNA, 22 bp, Artificial Sequence
  chemically synthesized
agtgtttattgctaggaaatag

SEQ ID NO: 1400186 - DNA, 22 bp, Artificial Sequence
  chemically synthesized
cagtgtttattgctaggaaata

SEQ ID NO: 1400187 - DNA, 22 bp, Artificial Sequence
  chemically synthesized
tcagtgtttattgctaggaaat

SEQ ID NO: 1400188 - DNA, 22 bp, Artificial Sequence
  chemically synthesized
tgtaatcaactatttcctagca

SEQ ID NO: 1400189 - DNA, 22 bp, Artificial Sequence
  chemically synthesized
ttcagtgtttattgctaggaaa

SEQ ID NO: 1400190 - DNA, 22 bp, Artificial Sequence
  chemically synthesized
taatcaactatttcctagcaat

SEQ ID NO: 1400191 - DNA, 22 bp, Artificial Sequence
  chemically synthesized
agtatgtttttcagtgtttatt

SEQ ID NO: 1400192 - DNA, 22 bp, Artificial Sequence
  chemically synthesized
tttcctagcaataaacactgaa

SEQ ID NO: 1400193 - DNA, 22 bp, Artificial Sequence
  chemically synthesized
cctagcaataaacactgaaaaa

SEQ ID NO: 1400194 - DNA, 22 bp, Artificial Sequence
  chemically synthesized
ctagcaataaacactgaaaaac

SEQ ID NO: 1400195 - DNA, 22 bp, Artificial Sequence
  chemically synthesized
gcaataaacactgaaaaacata

SEQ ID NO: 1400196 - DNA, 22 bp, Artificial Sequence
  chemically synthesized
gatgaaagttgagtatgttttt

SEQ ID NO: 1400197 - DNA, 22 bp, Artificial Sequence
  chemically synthesized
agatgaaagttgagtatgtttt

SEQ ID NO: 1400198 - DNA, 22 bp, Artificial Sequence
  chemically synthesized
ttagatgaaagttgagtatgtt

SEQ ID NO: 1400199 - DNA, 22 bp, Artificial Sequence
  chemically synthesized
tactcttagatgaaagttgagt

SEQ ID NO: 1400200 - DNA, 22 bp, Artificial Sequence
  chemically synthesized
gtactcttagatgaaagttgag

SEQ ID NO: 1400201 - DNA, 22 bp, Artificial Sequence
  chemically synthesized
ttgtactcttagatgaaagttg

SEQ ID NO: 1400202 - DNA, 22 bp, Artificial Sequence
  chemically synthesized
aaaaacatactcaactttcatc

SEQ ID NO: 1400203 - DNA, 22 bp, Artificial Sequence
  chemically synthesized
cttgtactcttagatgaaagtt

SEQ ID NO: 1400204 - DNA, 22 bp, Artificial Sequence
  chemically synthesized
cttcttgtactcttagatgaaa

SEQ ID NO: 1400205 - DNA, 22 bp, Artificial Sequence
  chemically synthesized
attacttcttgtactcttagat

SEQ ID NO: 1400206 - DNA, 22 bp, Artificial Sequence
  chemically synthesized
gattacttcttgtactcttaga

SEQ ID NO: 1400207 - DNA, 22 bp, Artificial Sequence
  chemically synthesized
aactttcatctaagagtacaag

SEQ ID NO: 1400208 - DNA, 22 bp, Artificial Sequence
  chemically synthesized
ccttgattacttcttgtactct

SEQ ID NO: 1400209 - DNA, 22 bp, Artificial Sequence
  chemically synthesized
tcatctaagagtacaagaagta

SEQ ID NO: 1400210 - DNA, 22 bp, Artificial Sequence
  chemically synthesized
catctaagagtacaagaagtaa

SEQ ID NO: 1400211 - DNA, 22 bp, Artificial Sequence
  chemically synthesized
ccattcccttgattacttcttg

SEQ ID NO: 1400212 - DNA, 22 bp, Artificial Sequence
  chemically synthesized
atctaagagtacaagaagtaat

SEQ ID NO: 1400213 - DNA, 22 bp, Artificial Sequence
  chemically synthesized
cccattcccttgattacttctt

SEQ ID NO: 1400214 - DNA, 22 bp, Artificial Sequence
  chemically synthesized
tcccattcccttgattacttct

SEQ ID NO: 1400215 - DNA, 22 bp, Artificial Sequence
  chemically synthesized
agagtacaagaagtaatcaagg

SEQ ID NO: 1400216 - DNA, 22 bp, Artificial Sequence
  chemically synthesized
agttttcccattcccttgatta

SEQ ID NO: 1400217 - DNA, 22 bp, Artificial Sequence
  chemically synthesized
attgagttttcccattcccttg

SEQ ID NO: 1400218 - DNA, 22 bp, Artificial Sequence
  chemically synthesized
gtagctaattgagttttcccat

SEQ ID NO: 1400219 - DNA, 22 bp, Artificial Sequence
  chemically synthesized
tggtagctaattgagttttccc

SEQ ID NO: 1400220 - DNA, 22 bp, Artificial Sequence
  chemically synthesized
cagtctctggtagctaattgag

SEQ ID NO: 1400221 - DNA, 22 bp, Artificial Sequence
  chemically synthesized
acagtctctggtagctaattga

SEQ ID NO: 1400222 - DNA, 22 bp, Artificial Sequence
  chemically synthesized
tacagtctctggtagctaattg

SEQ ID NO: 1400223 - DNA, 22 bp, Artificial Sequence
  chemically synthesized
aattagctaccagagactgtaa

SEQ ID NO: 1400224 - DNA, 22 bp, Artificial Sequence
  chemically synthesized
agaacagatgttttacagtctc

SEQ ID NO: 1400225 - DNA, 22 bp, Artificial Sequence
  chemically synthesized
cagaacagatgttttacagtct

SEQ ID NO: 1400226 - DNA, 22 bp, Artificial Sequence
  chemically synthesized
tcagaacagatgttttacagtc

SEQ ID NO: 1400227 - DNA, 22 bp, Artificial Sequence
  chemically synthesized
gctaccagagactgtaaaacat

SEQ ID NO: 1400228 - DNA, 22 bp, Artificial Sequence
  chemically synthesized
gttttcagaacagatgttttac

SEQ ID NO: 1400229 - DNA, 22 bp, Artificial Sequence
  chemically synthesized
ggttttcagaacagatgtttta

SEQ ID NO: 1400230 - DNA, 22 bp, Artificial Sequence
  chemically synthesized
ccagagactgtaaaacatctgt

SEQ ID NO: 1400231 - DNA, 22 bp, Artificial Sequence
  chemically synthesized
gagtttggttttcagaacagat

SEQ ID NO: 1400232 - DNA, 22 bp, Artificial Sequence
  chemically synthesized
ttggagtttggttttcagaaca

SEQ ID NO: 1400233 - DNA, 22 bp, Artificial Sequence
  chemically synthesized
taaaacatctgttctgaaaacc

SEQ ID NO: 1400234 - DNA, 22 bp, Artificial Sequence
  chemically synthesized
aattgttggagtttggttttca

SEQ ID NO: 1400235 - DNA, 22 bp, Artificial Sequence
  chemically synthesized
atattgaattgttggagtttgg

SEQ ID NO: 1400236 - DNA, 22 bp, Artificial Sequence
  chemically synthesized
ttctgaaaaccaaactccaaca

SEQ ID NO: 1400237 - DNA, 22 bp, Artificial Sequence
  chemically synthesized
tgaaaaccaaactccaacaatt

SEQ ID NO: 1400238 - DNA, 22 bp, Artificial Sequence
  chemically synthesized
aaaaccaaactccaacaattca

SEQ ID NO: 1400239 - DNA, 22 bp, Artificial Sequence
  chemically synthesized
aagatattgatattgaattgtt

SEQ ID NO: 1400240 - DNA, 22 bp, Artificial Sequence
  chemically synthesized
aaagatattgatattgaattgt

SEQ ID NO: 1400241 - DNA, 22 bp, Artificial Sequence
  chemically synthesized
taaagatattgatattgaattg

SEQ ID NO: 1400242 - DNA, 22 bp, Artificial Sequence
  chemically synthesized
tccctttaaagatattgatatt

SEQ ID NO: 1400243 - DNA, 22 bp, Artificial Sequence
  chemically synthesized
atccctttaaagatattgatat

SEQ ID NO: 1400244 - DNA, 22 bp, Artificial Sequence
  chemically synthesized
tatccctttaaagatattgata

SEQ ID NO: 1400245 - DNA, 22 bp, Artificial Sequence
  chemically synthesized
caacaattcaatatcaatatct

SEQ ID NO: 1400246 - DNA, 22 bp, Artificial Sequence
  chemically synthesized
ataatctttatccctttaaaga

SEQ ID NO: 1400247 - DNA, 22 bp, Artificial Sequence
  chemically synthesized
aatatcaatatctttaaaggga

SEQ ID NO: 1400248 - DNA, 22 bp, Artificial Sequence
  chemically synthesized
cattaataatctttatcccttt

SEQ ID NO: 1400249 - DNA, 22 bp, Artificial Sequence
  chemically synthesized
acattaataatctttatccctt

SEQ ID NO: 1400250 - DNA, 22 bp, Artificial Sequence
  chemically synthesized
tacattaataatctttatccct

SEQ ID NO: 1400251 - DNA, 22 bp, Artificial Sequence
  chemically synthesized
aattttacattaataatcttta

SEQ ID NO: 1400252 - DNA, 22 bp, Artificial Sequence
  chemically synthesized
taaagggataaagattattaat

SEQ ID NO: 1400253 - DNA, 22 bp, Artificial Sequence
  chemically synthesized
gttcaattttacattaataatc

SEQ ID NO: 1400254 - DNA, 22 bp, Artificial Sequence
  chemically synthesized
aaagggataaagattattaatg

SEQ ID NO: 1400255 - DNA, 22 bp, Artificial Sequence
  chemically synthesized
aagggataaagattattaatgt

SEQ ID NO: 1400256 - DNA, 22 bp, Artificial Sequence
  chemically synthesized
ctagttcaattttacattaata

SEQ ID NO: 1400257 - DNA, 22 bp, Artificial Sequence
  chemically synthesized
cctagttcaattttacattaat

SEQ ID NO: 1400258 - DNA, 22 bp, Artificial Sequence
  chemically synthesized
tcctagttcaattttacattaa

SEQ ID NO: 1400259 - DNA, 22 bp, Artificial Sequence
  chemically synthesized
atctttcctagttcaattttac

SEQ ID NO: 1400260 - DNA, 22 bp, Artificial Sequence
  chemically synthesized
catctttcctagttcaatttta

SEQ ID NO: 1400261 - DNA, 22 bp, Artificial Sequence
  chemically synthesized
tcatctttcctagttcaatttt

SEQ ID NO: 1400262 - DNA, 22 bp, Artificial Sequence
  chemically synthesized
ttcatctttcctagttcaattt

SEQ ID NO: 1400263 - DNA, 22 bp, Artificial Sequence
  chemically synthesized
ttaatgtaaaattgaactagga

SEQ ID NO: 1400264 - DNA, 22 bp, Artificial Sequence
  chemically synthesized
atgtaaaattgaactaggaaag

SEQ ID NO: 1400265 - DNA, 22 bp, Artificial Sequence
  chemically synthesized
gtgcaggggtttttcatctttc

SEQ ID NO: 1400266 - DNA, 22 bp, Artificial Sequence
  chemically synthesized
aactaggaaagatgaaaaaccc

SEQ ID NO: 1400267 - DNA, 22 bp, Artificial Sequence
  chemically synthesized
agaattagtgcaggggtttttc

SEQ ID NO: 1400268 - DNA, 22 bp, Artificial Sequence
  chemically synthesized
ggaaagatgaaaaacccctgca

SEQ ID NO: 1400269 - DNA, 22 bp, Artificial Sequence
  chemically synthesized
aacccaatataattgagaatta

SEQ ID NO: 1400270 - DNA, 22 bp, Artificial Sequence
  chemically synthesized
aaacccaatataattgagaatt

SEQ ID NO: 1400271 - DNA, 22 bp, Artificial Sequence
  chemically synthesized
taaacccaatataattgagaat

SEQ ID NO: 1400272 - DNA, 22 bp, Artificial Sequence
  chemically synthesized
ctttaaacccaatataattgag

SEQ ID NO: 1400273 - DNA, 22 bp, Artificial Sequence
  chemically synthesized
cctttaaacccaatataattga

SEQ ID NO: 1400274 - DNA, 22 bp, Artificial Sequence
  chemically synthesized
tcctttaaacccaatataattg

SEQ ID NO: 1400275 - DNA, 22 bp, Artificial Sequence
  chemically synthesized
cactaattctcaattatattgg

SEQ ID NO: 1400276 - DNA, 22 bp, Artificial Sequence
  chemically synthesized
cctttcctttaaacccaatata

SEQ ID NO: 1400277 - DNA, 22 bp, Artificial Sequence
  chemically synthesized
attctcaattatattgggttta

SEQ ID NO: 1400278 - DNA, 22 bp, Artificial Sequence
  chemically synthesized
ctgcctttcctttaaacccaat

SEQ ID NO: 1400279 - DNA, 22 bp, Artificial Sequence
  chemically synthesized
ttcctgcctttcctttaaaccc

SEQ ID NO: 1400280 - DNA, 22 bp, Artificial Sequence
  chemically synthesized
tcaattatattgggtttaaagg

SEQ ID NO: 1400281 - DNA, 22 bp, Artificial Sequence
  chemically synthesized
attcctgcctttcctttaaacc

SEQ ID NO: 1400282 - DNA, 22 bp, Artificial Sequence
  chemically synthesized
aattatattgggtttaaaggaa

SEQ ID NO: 1400283 - DNA, 22 bp, Artificial Sequence
  chemically synthesized
tattgggtttaaaggaaaggca

SEQ ID NO: 1400284 - DNA, 22 bp, Artificial Sequence
  chemically synthesized
ggtttaaaggaaaggcaggaat

SEQ ID NO: 1400285 - DNA, 22 bp, Artificial Sequence
  chemically synthesized
tgggtatatatgatttattcct

SEQ ID NO: 1400286 - DNA, 22 bp, Artificial Sequence
  chemically synthesized
aaaggaaaggcaggaataaatc

SEQ ID NO: 1400287 - DNA, 22 bp, Artificial Sequence
  chemically synthesized
aaggaaaggcaggaataaatca

SEQ ID NO: 1400288 - DNA, 22 bp, Artificial Sequence
  chemically synthesized
catctatgggtatatatgattt

SEQ ID NO: 1400289 - DNA, 22 bp, Artificial Sequence
  chemically synthesized
ccatctatgggtatatatgatt

SEQ ID NO: 1400290 - DNA, 22 bp, Artificial Sequence
  chemically synthesized
tttccatctatgggtatatatg

SEQ ID NO: 1400291 - DNA, 22 bp, Artificial Sequence
  chemically synthesized
gattatttccatctatgggtat

SEQ ID NO: 1400292 - DNA, 22 bp, Artificial Sequence
  chemically synthesized
atatatgtatgtgtgtgtgtat

SEQ ID NO: 1400293 - DNA, 22 bp, Artificial Sequence
  chemically synthesized
catatatgtatgtgtgtgtgta

SEQ ID NO: 1400294 - DNA, 22 bp, Artificial Sequence
  chemically synthesized
tcatatatgtatgtgtgtgtgt

SEQ ID NO: 1400295 - DNA, 22 bp, Artificial Sequence
  chemically synthesized
ttcatatatgtatgtgtgtgtg

SEQ ID NO: 1400296 - DNA, 22 bp, Artificial Sequence
  chemically synthesized
tagatttttcatatatgtatgt

SEQ ID NO: 1400297 - DNA, 22 bp, Artificial Sequence
  chemically synthesized
atagatttttcatatatgtatg

SEQ ID NO: 1400298 - DNA, 22 bp, Artificial Sequence
  chemically synthesized
acgcttatagatttttcatata

SEQ ID NO: 1400299 - DNA, 22 bp, Artificial Sequence
  chemically synthesized
atataaaacctaacgcttatag

SEQ ID NO: 1400300 - DNA, 22 bp, Artificial Sequence
  chemically synthesized
taagcgttaggttttatattag

SEQ ID NO: 1400301 - DNA, 22 bp, Artificial Sequence
  chemically synthesized
aaaatagatcatggatactaat

SEQ ID NO: 1400302 - DNA, 22 bp, Artificial Sequence
  chemically synthesized
ggttttatattagtatccatga

SEQ ID NO: 1400303 - DNA, 22 bp, Artificial Sequence
  chemically synthesized
actcaaaatagatcatggatac

SEQ ID NO: 1400304 - DNA, 22 bp, Artificial Sequence
  chemically synthesized
tatattagtatccatgatctat

SEQ ID NO: 1400305 - DNA, 22 bp, Artificial Sequence
  chemically synthesized
atattagtatccatgatctatt

SEQ ID NO: 1400306 - DNA, 22 bp, Artificial Sequence
  chemically synthesized
tattagtatccatgatctattt

SEQ ID NO: 1400307 - DNA, 22 bp, Artificial Sequence
  chemically synthesized
aaacattaactcaaaatagatc

SEQ ID NO: 1400308 - DNA, 22 bp, Artificial Sequence
  chemically synthesized
ttcaaacattaactcaaaatag

SEQ ID NO: 1400309 - DNA, 22 bp, Artificial Sequence
  chemically synthesized
gtatccatgatctattttgagt

SEQ ID NO: 1400310 - DNA, 22 bp, Artificial Sequence
  chemically synthesized
attcaaacattaactcaaaata

SEQ ID NO: 1400311 - DNA, 22 bp, Artificial Sequence
  chemically synthesized
tattcaaacattaactcaaaat

SEQ ID NO: 1400312 - DNA, 22 bp, Artificial Sequence
  chemically synthesized
atactttattcaaacattaact

SEQ ID NO: 1400313 - DNA, 22 bp, Artificial Sequence
  chemically synthesized
ttttgagttaatgtttgaataa

SEQ ID NO: 1400314 - DNA, 22 bp, Artificial Sequence
  chemically synthesized
aacacctcatactttattcaaa

SEQ ID NO: 1400315 - DNA, 22 bp, Artificial Sequence
  chemically synthesized
tgagttaatgtttgaataaagt

SEQ ID NO: 1400316 - DNA, 22 bp, Artificial Sequence
  chemically synthesized
gagttaatgtttgaataaagta

SEQ ID NO: 1400317 - DNA, 22 bp, Artificial Sequence
  chemically synthesized
agttaatgtttgaataaagtat

SEQ ID NO: 1400318 - DNA, 22 bp, Artificial Sequence
  chemically synthesized
acctgaacacctcatactttat

SEQ ID NO: 1400319 - DNA, 22 bp, Artificial Sequence
  chemically synthesized
gacctgaacacctcatacttta

SEQ ID NO: 1400320 - DNA, 22 bp, Artificial Sequence
  chemically synthesized
atgtttgaataaagtatgaggt

SEQ ID NO: 1400321 - DNA, 22 bp, Artificial Sequence
  chemically synthesized
gaataaagtatgaggtgttcag

SEQ ID NO: 1400322 - DNA, 22 bp, Artificial Sequence
  chemically synthesized
aataaagtatgaggtgttcagg

SEQ ID NO: 1400323 - DNA, 22 bp, Artificial Sequence
  chemically synthesized
gatacacataggcagagaaata

SEQ ID NO: 1400324 - DNA, 22 bp, Artificial Sequence
  chemically synthesized
ggatacacataggcagagaaat

SEQ ID NO: 1400325 - DNA, 22 bp, Artificial Sequence
  chemically synthesized
aggtcaagtttatttctctgcc

SEQ ID NO: 1400326 - DNA, 22 bp, Artificial Sequence
  chemically synthesized
gggtatttggatacacataggc

SEQ ID NO: 1400327 - DNA, 22 bp, Artificial Sequence
  chemically synthesized
atttctctgcctatgtgtatcc

SEQ ID NO: 1400328 - DNA, 22 bp, Artificial Sequence
  chemically synthesized
tttctctgcctatgtgtatcca

SEQ ID NO: 1400329 - DNA, 22 bp, Artificial Sequence
  chemically synthesized
ctctgcctatgtgtatccaaat

SEQ ID NO: 1400330 - DNA, 22 bp, Artificial Sequence
  chemically synthesized
tctgcctatgtgtatccaaata

SEQ ID NO: 1400331 - DNA, 22 bp, Artificial Sequence
  chemically synthesized
tgcctatgtgtatccaaatacc

SEQ ID NO: 1400332 - DNA, 22 bp, Artificial Sequence
  chemically synthesized
cctatgtgtatccaaataccct

SEQ ID NO: 1400333 - DNA, 22 bp, Artificial Sequence
  chemically synthesized
aacaaatgatgctagggtattt

SEQ ID NO: 1400334 - DNA, 22 bp, Artificial Sequence
  chemically synthesized
caacaaatgatgctagggtatt

SEQ ID NO: 1400335 - DNA, 22 bp, Artificial Sequence
  chemically synthesized
tcaacaaatgatgctagggtat

SEQ ID NO: 1400336 - DNA, 22 bp, Artificial Sequence
  chemically synthesized
tgtgtatccaaataccctagca

SEQ ID NO: 1400337 - DNA, 22 bp, Artificial Sequence
  chemically synthesized
tcattttcaacaaatgatgcta

SEQ ID NO: 1400338 - DNA, 22 bp, Artificial Sequence
  chemically synthesized
gcatcatttgttgaaaatgata

SEQ ID NO: 1400339 - DNA, 22 bp, Artificial Sequence
  chemically synthesized
aatgaaggaaactatcattttc

SEQ ID NO: 1400340 - DNA, 22 bp, Artificial Sequence
  chemically synthesized
gttgaaaatgatagtttccttc

SEQ ID NO: 1400341 - DNA, 22 bp, Artificial Sequence
  chemically synthesized
ttgaaaatgatagtttccttca

SEQ ID NO: 1400342 - DNA, 22 bp, Artificial Sequence
  chemically synthesized
aaaatgatagtttccttcattg

SEQ ID NO: 1400343 - DNA, 22 bp, Artificial Sequence
  chemically synthesized
caaaggtgtaaaagcaattcaa

SEQ ID NO: 1400344 - DNA, 22 bp, Artificial Sequence
  chemically synthesized
gcaaaggtgtaaaagcaattca

SEQ ID NO: 1400345 - DNA, 22 bp, Artificial Sequence
  chemically synthesized
tgcaaaggtgtaaaagcaattc

SEQ ID NO: 1400346 - DNA, 22 bp, Artificial Sequence
  chemically synthesized
tttgcaaaggtgtaaaagcaat

SEQ ID NO: 1400347 - DNA, 22 bp, Artificial Sequence
  chemically synthesized
ccttcattgaattgcttttaca

SEQ ID NO: 1400348 - DNA, 22 bp, Artificial Sequence
  chemically synthesized
cttcattgaattgcttttacac

SEQ ID NO: 1400349 - DNA, 22 bp, Artificial Sequence
  chemically synthesized
attctttgcaaaggtgtaaaag

SEQ ID NO: 1400350 - DNA, 22 bp, Artificial Sequence
  chemically synthesized
cattgaattgcttttacacctt

SEQ ID NO: 1400351 - DNA, 22 bp, Artificial Sequence
  chemically synthesized
attgaattgcttttacaccttt

SEQ ID NO: 1400352 - DNA, 22 bp, Artificial Sequence
  chemically synthesized
aattgcttttacacctttgcaa

SEQ ID NO: 1400353 - DNA, 22 bp, Artificial Sequence
  chemically synthesized
tgccaaactgattctttgcaaa

SEQ ID NO: 1400354 - DNA, 22 bp, Artificial Sequence
  chemically synthesized
cttttacacctttgcaaagaat

SEQ ID NO: 1400355 - DNA, 22 bp, Artificial Sequence
  chemically synthesized
ttatgccaaactgattctttgc

SEQ ID NO: 1400356 - DNA, 22 bp, Artificial Sequence
  chemically synthesized
ttacacctttgcaaagaatcag

SEQ ID NO: 1400357 - DNA, 22 bp, Artificial Sequence
  chemically synthesized
tacacctttgcaaagaatcagt

SEQ ID NO: 1400358 - DNA, 22 bp, Artificial Sequence
  chemically synthesized
acacctttgcaaagaatcagtt

SEQ ID NO: 1400359 - DNA, 22 bp, Artificial Sequence
  chemically synthesized
cacctttgcaaagaatcagttt

SEQ ID NO: 1400360 - DNA, 22 bp, Artificial Sequence
  chemically synthesized
tgcaaagaatcagtttggcata

SEQ ID NO: 1400361 - DNA, 22 bp, Artificial Sequence
  chemically synthesized
gcaaagaatcagtttggcataa

SEQ ID NO: 1400362 - DNA, 22 bp, Artificial Sequence
  chemically synthesized
caaagaatcagtttggcataat

SEQ ID NO: 1400363 - DNA, 22 bp, Artificial Sequence
  chemically synthesized
ggcataataatttccttctatt

SEQ ID NO: 1400364 - DNA, 22 bp, Artificial Sequence
  chemically synthesized
gcataataatttccttctattt

SEQ ID NO: 1400365 - DNA, 22 bp, Artificial Sequence
  chemically synthesized
ccttctatttctgggttctgta

SEQ ID NO: 1400366 - DNA, 22 bp, Artificial Sequence
  chemically synthesized
cttctatttctgggttctgtat

SEQ ID NO: 1400367 - DNA, 22 bp, Artificial Sequence
  chemically synthesized
ctatttctgggttctgtatttt

SEQ ID NO: 1400368 - DNA, 22 bp, Artificial Sequence
  chemically synthesized
tatttctgggttctgtatttta

SEQ ID NO: 1400369 - DNA, 22 bp, Artificial Sequence
  chemically synthesized
tttctgggttctgtattttatt

SEQ ID NO: 1400370 - DNA, 22 bp, Artificial Sequence
  chemically synthesized
ctgggttctgtattttattaca

SEQ ID NO: 1400371 - DNA, 22 bp, Artificial Sequence
  chemically synthesized
tgggttctgtattttattacat

SEQ ID NO: 1400372 - DNA, 22 bp, Artificial Sequence
  chemically synthesized
ggttctgtattttattacattg

SEQ ID NO: 1400373 - DNA, 22 bp, Artificial Sequence
  chemically synthesized
tgtattttattacattgctcca

SEQ ID NO: 1400374 - DNA, 22 bp, Artificial Sequence
  chemically synthesized
tattttattacattgctccatg

SEQ ID NO: 1400375 - DNA, 22 bp, Artificial Sequence
  chemically synthesized
gtggtgagacagaaacatggag

SEQ ID NO: 1400376 - DNA, 22 bp, Artificial Sequence
  chemically synthesized
tattacattgctccatgtttct

SEQ ID NO: 1400377 - DNA, 22 bp, Artificial Sequence
  chemically synthesized
attacattgctccatgtttctg

SEQ ID NO: 1400378 - DNA, 22 bp, Artificial Sequence
  chemically synthesized
ttacattgctccatgtttctgt

SEQ ID NO: 1400379 - DNA, 22 bp, Artificial Sequence
  chemically synthesized
cattgctccatgtttctgtctc

SEQ ID NO: 1400380 - DNA, 22 bp, Artificial Sequence
  chemically synthesized
ctccatgtttctgtctcaccac

SEQ ID NO: 1400381 - DNA, 22 bp, Artificial Sequence
  chemically synthesized
catgtttctgtctcaccaccaa

SEQ ID NO: 1400382 - DNA, 22 bp, Artificial Sequence
  chemically synthesized
ctgtctcaccaccaatatcaca

SEQ ID NO: 1400383 - DNA, 22 bp, Artificial Sequence
  chemically synthesized
tgtctcaccaccaatatcacat

SEQ ID NO: 1400384 - DNA, 22 bp, Artificial Sequence
  chemically synthesized
tctcaccaccaatatcacattg

SEQ ID NO: 1400385 - DNA, 22 bp, Artificial Sequence
  chemically synthesized
cagtaatgaagacaatgtgata

SEQ ID NO: 1400386 - DNA, 22 bp, Artificial Sequence
  chemically synthesized
accaccaatatcacattgtctt

SEQ ID NO: 1400387 - DNA, 22 bp, Artificial Sequence
  chemically synthesized
gtatatagctacagtaatgaag

SEQ ID NO: 1400388 - DNA, 22 bp, Artificial Sequence
  chemically synthesized
agtatatagctacagtaatgaa

SEQ ID NO: 1400389 - DNA, 22 bp, Artificial Sequence
  chemically synthesized
tcttcattactgtagctatata

SEQ ID NO: 1400390 - DNA, 22 bp, Artificial Sequence
  chemically synthesized
cattactgtagctatatactaa

SEQ ID NO: 1400391 - DNA, 22 bp, Artificial Sequence
  chemically synthesized
aacatgaagaccttagtatata

SEQ ID NO: 1400392 - DNA, 22 bp, Artificial Sequence
  chemically synthesized
attactgtagctatatactaag

SEQ ID NO: 1400393 - DNA, 22 bp, Artificial Sequence
  chemically synthesized
ctcaacatgaagaccttagtat

SEQ ID NO: 1400394 - DNA, 22 bp, Artificial Sequence
  chemically synthesized
ctgtagctatatactaaggtct

SEQ ID NO: 1400395 - DNA, 22 bp, Artificial Sequence
  chemically synthesized
tactcaacatgaagaccttagt

SEQ ID NO: 1400396 - DNA, 22 bp, Artificial Sequence
  chemically synthesized
tagctatatactaaggtcttca

SEQ ID NO: 1400397 - DNA, 22 bp, Artificial Sequence
  chemically synthesized
ctctactcaacatgaagacctt

SEQ ID NO: 1400398 - DNA, 22 bp, Artificial Sequence
  chemically synthesized
tatactaaggtcttcatgttga

SEQ ID NO: 1400399 - DNA, 22 bp, Artificial Sequence
  chemically synthesized
aggtcttcatgttgagtagagc

SEQ ID NO: 1400400 - DNA, 22 bp, Artificial Sequence
  chemically synthesized
atgtgggaggaattgctctact

SEQ ID NO: 1400401 - DNA, 22 bp, Artificial Sequence
  chemically synthesized
catgttgagtagagcaattcct

SEQ ID NO: 1400402 - DNA, 22 bp, Artificial Sequence
  chemically synthesized
atgttgagtagagcaattcctc

SEQ ID NO: 1400403 - DNA, 22 bp, Artificial Sequence
  chemically synthesized
aaaacgattaatgtgggaggaa

SEQ ID NO: 1400404 - DNA, 22 bp, Artificial Sequence
  chemically synthesized
agtagagcaattcctcccacat

SEQ ID NO: 1400405 - DNA, 22 bp, Artificial Sequence
  chemically synthesized
atgactgaaaacgattaatgtg

SEQ ID NO: 1400406 - DNA, 22 bp, Artificial Sequence
  chemically synthesized
catgactgaaaacgattaatgt

SEQ ID NO: 1400407 - DNA, 22 bp, Artificial Sequence
  chemically synthesized
ctcccacattaatcgttttcag

SEQ ID NO: 1400408 - DNA, 22 bp, Artificial Sequence
  chemically synthesized
tagatttcatgactgaaaacga

SEQ ID NO: 1400409 - DNA, 22 bp, Artificial Sequence
  chemically synthesized
ccacattaatcgttttcagtca

SEQ ID NO: 1400410 - DNA, 22 bp, Artificial Sequence
  chemically synthesized
atcgttttcagtcatgaaatct

SEQ ID NO: 1400411 - DNA, 22 bp, Artificial Sequence
  chemically synthesized
ccaaatcgatctatagatttca

SEQ ID NO: 1400412 - DNA, 22 bp, Artificial Sequence
  chemically synthesized
cccaaatcgatctatagatttc

SEQ ID NO: 1400413 - DNA, 22 bp, Artificial Sequence
  chemically synthesized
ttcccaaatcgatctatagatt

SEQ ID NO: 1400414 - DNA, 22 bp, Artificial Sequence
  chemically synthesized
tcagtcatgaaatctatagatc

SEQ ID NO: 1400415 - DNA, 22 bp, Artificial Sequence
  chemically synthesized
cagtcatgaaatctatagatcg

SEQ ID NO: 1400416 - DNA, 22 bp, Artificial Sequence
  chemically synthesized
agtcatgaaatctatagatcga

SEQ ID NO: 1400417 - DNA, 22 bp, Artificial Sequence
  chemically synthesized
tagatcgatttgggaagaattg

SEQ ID NO: 1400418 - DNA, 22 bp, Artificial Sequence
  chemically synthesized
agcatagtaaagatgtcaattc

SEQ ID NO: 1400419 - DNA, 22 bp, Artificial Sequence
  chemically synthesized
gggaagaattgacatctttact

SEQ ID NO: 1400420 - DNA, 22 bp, Artificial Sequence
  chemically synthesized
ggaagaattgacatctttacta

SEQ ID NO: 1400421 - DNA, 22 bp, Artificial Sequence
  chemically synthesized
gaagactcagcatagtaaagat

SEQ ID NO: 1400422 - DNA, 22 bp, Artificial Sequence
  chemically synthesized
atggattggaagactcagcata

SEQ ID NO: 1400423 - DNA, 22 bp, Artificial Sequence
  chemically synthesized
acatctttactatgctgagtct

SEQ ID NO: 1400424 - DNA, 22 bp, Artificial Sequence
  chemically synthesized
cattcatggattggaagactca

SEQ ID NO: 1400425 - DNA, 22 bp, Artificial Sequence
  chemically synthesized
tactatgctgagtcttccaatc

SEQ ID NO: 1400426 - DNA, 22 bp, Artificial Sequence
  chemically synthesized
actatgctgagtcttccaatcc

SEQ ID NO: 1400427 - DNA, 22 bp, Artificial Sequence
  chemically synthesized
ctatgctgagtcttccaatcca

SEQ ID NO: 1400428 - DNA, 22 bp, Artificial Sequence
  chemically synthesized
tgctgagtcttccaatccatga

SEQ ID NO: 1400429 - DNA, 22 bp, Artificial Sequence
  chemically synthesized
agggatatattgcattcatgga

SEQ ID NO: 1400430 - DNA, 22 bp, Artificial Sequence
  chemically synthesized
cagggatatattgcattcatgg

SEQ ID NO: 1400431 - DNA, 22 bp, Artificial Sequence
  chemically synthesized
agtcttccaatccatgaatgca

SEQ ID NO: 1400432 - DNA, 22 bp, Artificial Sequence
  chemically synthesized
ccaatccatgaatgcaatatat

SEQ ID NO: 1400433 - DNA, 22 bp, Artificial Sequence
  chemically synthesized
caatccatgaatgcaatatatc

SEQ ID NO: 1400434 - DNA, 22 bp, Artificial Sequence
  chemically synthesized
aataatttcagggatatattgc

SEQ ID NO: 1400435 - DNA, 22 bp, Artificial Sequence
  chemically synthesized
ataaaagaaatcaagacctaaa

SEQ ID NO: 1400436 - DNA, 22 bp, Artificial Sequence
  chemically synthesized
aaattatttaggtcttgatttc

SEQ ID NO: 1400437 - DNA, 22 bp, Artificial Sequence
  chemically synthesized
caaaatgctgataaaagaaatc

SEQ ID NO: 1400438 - DNA, 22 bp, Artificial Sequence
  chemically synthesized
tttaggtcttgatttcttttat

SEQ ID NO: 1400439 - DNA, 22 bp, Artificial Sequence
  chemically synthesized
aggtcttgatttcttttatcag

SEQ ID NO: 1400440 - DNA, 22 bp, Artificial Sequence
  chemically synthesized
ggtcttgatttcttttatcagc

SEQ ID NO: 1400441 - DNA, 22 bp, Artificial Sequence
  chemically synthesized
aaaattacaaaatgctgataaa

SEQ ID NO: 1400442 - DNA, 22 bp, Artificial Sequence
  chemically synthesized
gatttcttttatcagcattttg

SEQ ID NO: 1400443 - DNA, 22 bp, Artificial Sequence
  chemically synthesized
atttcttttatcagcattttgt

SEQ ID NO: 1400444 - DNA, 22 bp, Artificial Sequence
  chemically synthesized
cttttatcagcattttgtaatt

SEQ ID NO: 1400445 - DNA, 22 bp, Artificial Sequence
  chemically synthesized
ttttatcagcattttgtaattt

SEQ ID NO: 1400446 - DNA, 22 bp, Artificial Sequence
  chemically synthesized
ttatcagcattttgtaattttc

SEQ ID NO: 1400447 - DNA, 22 bp, Artificial Sequence
  chemically synthesized
tatcagcattttgtaattttca

SEQ ID NO: 1400448 - DNA, 22 bp, Artificial Sequence
  chemically synthesized
atcagcattttgtaattttcag

SEQ ID NO: 1400449 - DNA, 22 bp, Artificial Sequence
  chemically synthesized
tcagcattttgtaattttcagg

SEQ ID NO: 1400450 - DNA, 22 bp, Artificial Sequence
  chemically synthesized
tgtaattttcaggatatatatc

SEQ ID NO: 1400451 - DNA, 22 bp, Artificial Sequence
  chemically synthesized
gtaattttcaggatatatatct

SEQ ID NO: 1400452 - DNA, 22 bp, Artificial Sequence
  chemically synthesized
taattttcaggatatatatctc

SEQ ID NO: 1400453 - DNA, 22 bp, Artificial Sequence
  chemically synthesized
acaatatatatatgagatatat

SEQ ID NO: 1400454 - DNA, 22 bp, Artificial Sequence
  chemically synthesized
tcaggatatatatctcatatat

SEQ ID NO: 1400455 - DNA, 22 bp, Artificial Sequence
  chemically synthesized
caggatatatatctcatatata

SEQ ID NO: 1400456 - DNA, 22 bp, Artificial Sequence
  chemically synthesized
aggatatatatctcatatatat

SEQ ID NO: 1400457 - DNA, 22 bp, Artificial Sequence
  chemically synthesized
atatatatattgttaatatctt

SEQ ID NO: 1400458 - DNA, 22 bp, Artificial Sequence
  chemically synthesized
cccaaaaatgaaatagtaagat

SEQ ID NO: 1400459 - DNA, 22 bp, Artificial Sequence
  chemically synthesized
ttccccaaaaatgaaatagtaa

SEQ ID NO: 1400460 - DNA, 22 bp, Artificial Sequence
  chemically synthesized
ttattccccaaaaatgaaatag

SEQ ID NO: 1400461 - DNA, 22 bp, Artificial Sequence
  chemically synthesized
ttaatatcttactatttcattt

SEQ ID NO: 1400462 - DNA, 22 bp, Artificial Sequence
  chemically synthesized
ctattattccccaaaaatgaaa

SEQ ID NO: 1400463 - DNA, 22 bp, Artificial Sequence
  chemically synthesized
atatcttactatttcatttttg

SEQ ID NO: 1400464 - DNA, 22 bp, Artificial Sequence
  chemically synthesized
actattattccccaaaaatgaa

SEQ ID NO: 1400465 - DNA, 22 bp, Artificial Sequence
  chemically synthesized
actatttcatttttggggaata

SEQ ID NO: 1400466 - DNA, 22 bp, Artificial Sequence
  chemically synthesized
ctatttcatttttggggaataa

SEQ ID NO: 1400467 - DNA, 22 bp, Artificial Sequence
  chemically synthesized
tttcatttttggggaataatag

SEQ ID NO: 1400468 - DNA, 22 bp, Artificial Sequence
  chemically synthesized
catttttggggaataatagtaa

SEQ ID NO: 1400469 - DNA, 22 bp, Artificial Sequence
  chemically synthesized
atttttggggaataatagtaaa

SEQ ID NO: 1400470 - DNA, 22 bp, Artificial Sequence
  chemically synthesized
ttggggaataatagtaaatgct

SEQ ID NO: 1400471 - DNA, 22 bp, Artificial Sequence
  chemically synthesized
tggggaataatagtaaatgcta

SEQ ID NO: 1400472 - DNA, 22 bp, Artificial Sequence
  chemically synthesized
ggggaataatagtaaatgctat

SEQ ID NO: 1400473 - DNA, 22 bp, Artificial Sequence
  chemically synthesized
gggaataatagtaaatgctatt

SEQ ID NO: 1400474 - DNA, 22 bp, Artificial Sequence
  chemically synthesized
aaaacacaaaaagaaaaaagaa

SEQ ID NO: 1400475 - DNA, 22 bp, Artificial Sequence
  chemically synthesized
gaattaaaaacacaaaaagaaa

SEQ ID NO: 1400476 - DNA, 22 bp, Artificial Sequence
  chemically synthesized
tttttttcttttttctttttgt

SEQ ID NO: 1400477 - DNA, 22 bp, Artificial Sequence
  chemically synthesized
agaattaaaaacacaaaaagaa

SEQ ID NO: 1400478 - DNA, 22 bp, Artificial Sequence
  chemically synthesized
ttttcttttttctttttgtgtt

SEQ ID NO: 1400479 - DNA, 22 bp, Artificial Sequence
  chemically synthesized
tttcttttttctttttgtgttt

SEQ ID NO: 1400480 - DNA, 22 bp, Artificial Sequence
  chemically synthesized
ttcttttttctttttgtgtttt

SEQ ID NO: 1400481 - DNA, 22 bp, Artificial Sequence
  chemically synthesized
tcttttttctttttgtgttttt

SEQ ID NO: 1400482 - DNA, 22 bp, Artificial Sequence
  chemically synthesized
cttttttctttttgtgttttta

SEQ ID NO: 1400483 - DNA, 22 bp, Artificial Sequence
  chemically synthesized
aaaatttagaattaaaaacaca

SEQ ID NO: 1400484 - DNA, 22 bp, Artificial Sequence
  chemically synthesized
ttttttctttttgtgtttttaa

SEQ ID NO: 1400485 - DNA, 22 bp, Artificial Sequence
  chemically synthesized
aaaaatttagaattaaaaacac

SEQ ID NO: 1400486 - DNA, 22 bp, Artificial Sequence
  chemically synthesized
taaaaatttagaattaaaaaca

SEQ ID NO: 1400487 - DNA, 22 bp, Artificial Sequence
  chemically synthesized
ttttctttttgtgtttttaatt

SEQ ID NO: 1400488 - DNA, 22 bp, Artificial Sequence
  chemically synthesized
ttaaaaatttagaattaaaaac

SEQ ID NO: 1400489 - DNA, 22 bp, Artificial Sequence
  chemically synthesized
tttctttttgtgtttttaattc

SEQ ID NO: 1400490 - DNA, 22 bp, Artificial Sequence
  chemically synthesized
tttaaaaatttagaattaaaaa

SEQ ID NO: 1400491 - DNA, 22 bp, Artificial Sequence
  chemically synthesized
ttctttttgtgtttttaattct

SEQ ID NO: 1400492 - DNA, 22 bp, Artificial Sequence
  chemically synthesized
tctttttgtgtttttaattcta

SEQ ID NO: 1400493 - DNA, 22 bp, Artificial Sequence
  chemically synthesized
tttttaaaaatttagaattaaa

SEQ ID NO: 1400494 - DNA, 22 bp, Artificial Sequence
  chemically synthesized
ctttttgtgtttttaattctaa

SEQ ID NO: 1400495 - DNA, 22 bp, Artificial Sequence
  chemically synthesized
ctttttaaaaatttagaattaa

SEQ ID NO: 1400496 - DNA, 22 bp, Artificial Sequence
  chemically synthesized
tttttgtgtttttaattctaaa

SEQ ID NO: 1400497 - DNA, 22 bp, Artificial Sequence
  chemically synthesized
tttgtgtttttaattctaaatt

SEQ ID NO: 1400498 - DNA, 22 bp, Artificial Sequence
  chemically synthesized
ttgtgtttttaattctaaattt

SEQ ID NO: 1400499 - DNA, 22 bp, Artificial Sequence
  chemically synthesized
tgtgtttttaattctaaatttt

SEQ ID NO: 1400500 - DNA, 22 bp, Artificial Sequence
  chemically synthesized
gtgtttttaattctaaattttt

SEQ ID NO: 1400501 - DNA, 22 bp, Artificial Sequence
  chemically synthesized
aaatttctttttaaaaatttag

SEQ ID NO: 1400502 - DNA, 22 bp, Artificial Sequence
  chemically synthesized
tgtttttaattctaaattttta

SEQ ID NO: 1400503 - DNA, 22 bp, Artificial Sequence
  chemically synthesized
aaaatttctttttaaaaattta

SEQ ID NO: 1400504 - DNA, 22 bp, Artificial Sequence
  chemically synthesized
ttaaaatttctttttaaaaatt

SEQ ID NO: 1400505 - DNA, 22 bp, Artificial Sequence
  chemically synthesized
ttaattctaaatttttaaaaag

SEQ ID NO: 1400506 - DNA, 22 bp, Artificial Sequence
  chemically synthesized
taattctaaatttttaaaaaga

SEQ ID NO: 1400507 - DNA, 22 bp, Artificial Sequence
  chemically synthesized
aattctaaatttttaaaaagaa

SEQ ID NO: 1400508 - DNA, 22 bp, Artificial Sequence
  chemically synthesized
attctaaatttttaaaaagaaa

SEQ ID NO: 1400509 - DNA, 22 bp, Artificial Sequence
  chemically synthesized
gatattcttaaaatttcttttt

SEQ ID NO: 1400510 - DNA, 22 bp, Artificial Sequence
  chemically synthesized
agatattcttaaaatttctttt

SEQ ID NO: 1400511 - DNA, 22 bp, Artificial Sequence
  chemically synthesized
tagatattcttaaaatttcttt

SEQ ID NO: 1400512 - DNA, 22 bp, Artificial Sequence
  chemically synthesized
taaatttttaaaaagaaatttt

SEQ ID NO: 1400513 - DNA, 22 bp, Artificial Sequence
  chemically synthesized
aatttttaaaaagaaattttaa

SEQ ID NO: 1400514 - DNA, 22 bp, Artificial Sequence
  chemically synthesized
aaattttagatattcttaaaat

SEQ ID NO: 1400515 - DNA, 22 bp, Artificial Sequence
  chemically synthesized
gaaattttagatattcttaaaa

SEQ ID NO: 1400516 - DNA, 22 bp, Artificial Sequence
  chemically synthesized
ttaaaaagaaattttaagaata

SEQ ID NO: 1400517 - DNA, 22 bp, Artificial Sequence
  chemically synthesized
taaaaagaaattttaagaatat

SEQ ID NO: 1400518 - DNA, 22 bp, Artificial Sequence
  chemically synthesized
aaaaagaaattttaagaatatc

SEQ ID NO: 1400519 - DNA, 22 bp, Artificial Sequence
  chemically synthesized
aaaagaaattttaagaatatct

SEQ ID NO: 1400520 - DNA, 22 bp, Artificial Sequence
  chemically synthesized
gcgtttgaaattttagatattc

SEQ ID NO: 1400521 - DNA, 22 bp, Artificial Sequence
  chemically synthesized
ggcgtttgaaattttagatatt

SEQ ID NO: 1400522 - DNA, 22 bp, Artificial Sequence
  chemically synthesized
taagaatatctaaaatttcaaa

SEQ ID NO: 1400523 - DNA, 22 bp, Artificial Sequence
  chemically synthesized
aagaatatctaaaatttcaaac

SEQ ID NO: 1400524 - DNA, 22 bp, Artificial Sequence
  chemically synthesized
agaatatctaaaatttcaaacg

SEQ ID NO: 1400525 - DNA, 22 bp, Artificial Sequence
  chemically synthesized
gaaggaacttggcgtttgaaat

SEQ ID NO: 1400526 - DNA, 22 bp, Artificial Sequence
  chemically synthesized
ctagaaggaacttggcgtttga

SEQ ID NO: 1400527 - DNA, 22 bp, Artificial Sequence
  chemically synthesized
ttgctagaaggaacttggcgtt

SEQ ID NO: 1400528 - DNA, 22 bp, Artificial Sequence
  chemically synthesized
aaatttcaaacgccaagttcct

SEQ ID NO: 1400529 - DNA, 22 bp, Artificial Sequence
  chemically synthesized
ccattattgctagaaggaactt

SEQ ID NO: 1400530 - DNA, 22 bp, Artificial Sequence
  chemically synthesized
cccattattgctagaaggaact

SEQ ID NO: 1400531 - DNA, 22 bp, Artificial Sequence
  chemically synthesized
tcccattattgctagaaggaac

SEQ ID NO: 1400532 - DNA, 22 bp, Artificial Sequence
  chemically synthesized
ttcccattattgctagaaggaa

SEQ ID NO: 1400533 - DNA, 22 bp, Artificial Sequence
  chemically synthesized
caaacgccaagttccttctagc

SEQ ID NO: 1400534 - DNA, 22 bp, Artificial Sequence
  chemically synthesized
aaacgccaagttccttctagca

SEQ ID NO: 1400535 - DNA, 22 bp, Artificial Sequence
  chemically synthesized
atttttcccattattgctagaa

SEQ ID NO: 1400536 - DNA, 22 bp, Artificial Sequence
  chemically synthesized
cttctagcaataatgggaaaaa

SEQ ID NO: 1400537 - DNA, 22 bp, Artificial Sequence
  chemically synthesized
aaaataaacgttaatttttccc

SEQ ID NO: 1400538 - DNA, 22 bp, Artificial Sequence
  chemically synthesized
ctagcaataatgggaaaaatta

SEQ ID NO: 1400539 - DNA, 22 bp, Artificial Sequence
  chemically synthesized
caaaataaacgttaatttttcc

SEQ ID NO: 1400540 - DNA, 22 bp, Artificial Sequence
  chemically synthesized
tagcaataatgggaaaaattaa

SEQ ID NO: 1400541 - DNA, 22 bp, Artificial Sequence
  chemically synthesized
gcaataatgggaaaaattaacg

SEQ ID NO: 1400542 - DNA, 22 bp, Artificial Sequence
  chemically synthesized
tcagataagaaaaaaaaccttc

SEQ ID NO: 1400543 - DNA, 22 bp, Artificial Sequence
  chemically synthesized
acgtttattttgaaggtttttt

SEQ ID NO: 1400544 - DNA, 22 bp, Artificial Sequence
  chemically synthesized
gtcagataagaaaaaaaacctt

SEQ ID NO: 1400545 - DNA, 22 bp, Artificial Sequence
  chemically synthesized
attttgaaggttttttttctta

SEQ ID NO: 1400546 - DNA, 22 bp, Artificial Sequence
  chemically synthesized
ttttgaaggttttttttcttat

SEQ ID NO: 1400547 - DNA, 22 bp, Artificial Sequence
  chemically synthesized
tgaaggttttttttcttatctg

SEQ ID NO: 1400548 - DNA, 22 bp, Artificial Sequence
  chemically synthesized
aacatcacttgtcagataagaa

SEQ ID NO: 1400549 - DNA, 22 bp, Artificial Sequence
  chemically synthesized
gaaggttttttttcttatctga

SEQ ID NO: 1400550 - DNA, 22 bp, Artificial Sequence
  chemically synthesized
aaggttttttttcttatctgac

SEQ ID NO: 1400551 - DNA, 22 bp, Artificial Sequence
  chemically synthesized
tttttcttatctgacaagtgat

SEQ ID NO: 1400552 - DNA, 22 bp, Artificial Sequence
  chemically synthesized
ttttcttatctgacaagtgatg

SEQ ID NO: 1400553 - DNA, 22 bp, Artificial Sequence
  chemically synthesized
tttcttatctgacaagtgatgt

SEQ ID NO: 1400554 - DNA, 22 bp, Artificial Sequence
  chemically synthesized
ttcttatctgacaagtgatgtt

SEQ ID NO: 1400555 - DNA, 22 bp, Artificial Sequence
  chemically synthesized
tcttatctgacaagtgatgttg

SEQ ID NO: 1400556 - DNA, 22 bp, Artificial Sequence
  chemically synthesized
cttatctgacaagtgatgttga

SEQ ID NO: 1400557 - DNA, 22 bp, Artificial Sequence
  chemically synthesized
tgtaagtgagattcaacatcac

SEQ ID NO: 1400558 - DNA, 22 bp, Artificial Sequence
  chemically synthesized
ttatctgacaagtgatgttgaa

SEQ ID NO: 1400559 - DNA, 22 bp, Artificial Sequence
  chemically synthesized
atctgacaagtgatgttgaatc

SEQ ID NO: 1400560 - DNA, 22 bp, Artificial Sequence
  chemically synthesized
tctgacaagtgatgttgaatct

SEQ ID NO: 1400561 - DNA, 22 bp, Artificial Sequence
  chemically synthesized
attgtgtaagtgagattcaaca

SEQ ID NO: 1400562 - DNA, 22 bp, Artificial Sequence
  chemically synthesized
aattgtgtaagtgagattcaac

SEQ ID NO: 1400563 - DNA, 22 bp, Artificial Sequence
  chemically synthesized
taattgtgtaagtgagattcaa

SEQ ID NO: 1400564 - DNA, 22 bp, Artificial Sequence
  chemically synthesized
ttaattgtgtaagtgagattca

SEQ ID NO: 1400565 - DNA, 22 bp, Artificial Sequence
  chemically synthesized
acaagtgatgttgaatctcact

SEQ ID NO: 1400566 - DNA, 22 bp, Artificial Sequence
  chemically synthesized
tttaattgtgtaagtgagattc

SEQ ID NO: 1400567 - DNA, 22 bp, Artificial Sequence
  chemically synthesized
tttttaattgtgtaagtgagat

SEQ ID NO: 1400568 - DNA, 22 bp, Artificial Sequence
  chemically synthesized
ctttttaattgtgtaagtgaga

SEQ ID NO: 1400569 - DNA, 22 bp, Artificial Sequence
  chemically synthesized
tttctttttaattgtgtaagtg

SEQ ID NO: 1400570 - DNA, 22 bp, Artificial Sequence
  chemically synthesized
aatctcacttacacaattaaaa

SEQ ID NO: 1400571 - DNA, 22 bp, Artificial Sequence
  chemically synthesized
tgtattgtttctttttaattgt

SEQ ID NO: 1400572 - DNA, 22 bp, Artificial Sequence
  chemically synthesized
ttgtgtattgtttctttttaat

SEQ ID NO: 1400573 - DNA, 22 bp, Artificial Sequence
  chemically synthesized
acttacacaattaaaaagaaac

SEQ ID NO: 1400574 - DNA, 22 bp, Artificial Sequence
  chemically synthesized
acacaattaaaaagaaacaata

SEQ ID NO: 1400575 - DNA, 22 bp, Artificial Sequence
  chemically synthesized
cacaattaaaaagaaacaatac

SEQ ID NO: 1400576 - DNA, 22 bp, Artificial Sequence
  chemically synthesized
taatagttattgtgtattgttt

SEQ ID NO: 1400577 - DNA, 22 bp, Artificial Sequence
  chemically synthesized
ttgtaatagttattgtgtattg

SEQ ID NO: 1400578 - DNA, 22 bp, Artificial Sequence
  chemically synthesized
gttgtaatagttattgtgtatt

SEQ ID NO: 1400579 - DNA, 22 bp, Artificial Sequence
  chemically synthesized
tgttgtaatagttattgtgtat

SEQ ID NO: 1400580 - DNA, 22 bp, Artificial Sequence
  chemically synthesized
aaaagaaacaatacacaataac

SEQ ID NO: 1400581 - DNA, 22 bp, Artificial Sequence
  chemically synthesized
attttgttgtaatagttattgt

SEQ ID NO: 1400582 - DNA, 22 bp, Artificial Sequence
  chemically synthesized
ttcattttgttgtaatagttat

SEQ ID NO: 1400583 - DNA, 22 bp, Artificial Sequence
  chemically synthesized
ttacaacaaaatgaacagactt

SEQ ID NO: 1400584 - DNA, 22 bp, Artificial Sequence
  chemically synthesized
aaaccagtaccaaagtctgttc

SEQ ID NO: 1400585 - DNA, 22 bp, Artificial Sequence
  chemically synthesized
caaaccagtaccaaagtctgtt

SEQ ID NO: 1400586 - DNA, 22 bp, Artificial Sequence
  chemically synthesized
caacaaaatgaacagactttgg

SEQ ID NO: 1400587 - DNA, 22 bp, Artificial Sequence
  chemically synthesized
ttcaaaccagtaccaaagtctg

SEQ ID NO: 1400588 - DNA, 22 bp, Artificial Sequence
  chemically synthesized
atctcttcaaaccagtaccaaa

SEQ ID NO: 1400589 - DNA, 22 bp, Artificial Sequence
  chemically synthesized
aatctcttcaaaccagtaccaa

SEQ ID NO: 1400590 - DNA, 22 bp, Artificial Sequence
  chemically synthesized
ttaatctcttcaaaccagtacc

SEQ ID NO: 1400591 - DNA, 22 bp, Artificial Sequence
  chemically synthesized
agctcttaatctcttcaaacca

SEQ ID NO: 1400592 - DNA, 22 bp, Artificial Sequence
  chemically synthesized
aagctcttaatctcttcaaacc

SEQ ID NO: 1400593 - DNA, 22 bp, Artificial Sequence
  chemically synthesized
tggtactggtttgaagagatta

SEQ ID NO: 1400594 - DNA, 22 bp, Artificial Sequence
  chemically synthesized
ggtactggtttgaagagattaa

SEQ ID NO: 1400595 - DNA, 22 bp, Artificial Sequence
  chemically synthesized
gtactggtttgaagagattaag

SEQ ID NO: 1400596 - DNA, 22 bp, Artificial Sequence
  chemically synthesized
agaccatttaagctcttaatct

SEQ ID NO: 1400597 - DNA, 22 bp, Artificial Sequence
  chemically synthesized
aagaccatttaagctcttaatc

SEQ ID NO: 1400598 - DNA, 22 bp, Artificial Sequence
  chemically synthesized
taagaccatttaagctcttaat

SEQ ID NO: 1400599 - DNA, 22 bp, Artificial Sequence
  chemically synthesized
gtttgaagagattaagagctta

SEQ ID NO: 1400600 - DNA, 22 bp, Artificial Sequence
  chemically synthesized
tttaagaccatttaagctctta

SEQ ID NO: 1400601 - DNA, 22 bp, Artificial Sequence
  chemically synthesized
gaagagattaagagcttaaatg

SEQ ID NO: 1400602 - DNA, 22 bp, Artificial Sequence
  chemically synthesized
aagagattaagagcttaaatgg

SEQ ID NO: 1400603 - DNA, 22 bp, Artificial Sequence
  chemically synthesized
agagcttaaatggtcttaaaga

SEQ ID NO: 1400604 - DNA, 22 bp, Artificial Sequence
  chemically synthesized
aaatggtcttaaagagattata

SEQ ID NO: 1400605 - DNA, 22 bp, Artificial Sequence
  chemically synthesized
gcaaatgagcaatataatctct

SEQ ID NO: 1400606 - DNA, 22 bp, Artificial Sequence
  chemically synthesized
aatggtcttaaagagattatat

SEQ ID NO: 1400607 - DNA, 22 bp, Artificial Sequence
  chemically synthesized
tggcaaatgagcaatataatct

SEQ ID NO: 1400608 - DNA, 22 bp, Artificial Sequence
  chemically synthesized
aaagagattatattgctcattt

SEQ ID NO: 1400609 - DNA, 22 bp, Artificial Sequence
  chemically synthesized
aagagattatattgctcatttg

SEQ ID NO: 1400610 - DNA, 22 bp, Artificial Sequence
  chemically synthesized
aaagcatggattctggcaaatg

SEQ ID NO: 1400611 - DNA, 22 bp, Artificial Sequence
  chemically synthesized
gaaagcatggattctggcaaat

SEQ ID NO: 1400612 - DNA, 22 bp, Artificial Sequence
  chemically synthesized
tgaaagcatggattctggcaaa

SEQ ID NO: 1400613 - DNA, 22 bp, Artificial Sequence
  chemically synthesized
tttgaaagcatggattctggca

SEQ ID NO: 1400614 - DNA, 22 bp, Artificial Sequence
  chemically synthesized
tattgctcatttgccagaatcc

SEQ ID NO: 1400615 - DNA, 22 bp, Artificial Sequence
  chemically synthesized
ctttgaaagcatggattctggc

SEQ ID NO: 1400616 - DNA, 22 bp, Artificial Sequence
  chemically synthesized
ctcatttgccagaatccatgct

SEQ ID NO: 1400617 - DNA, 22 bp, Artificial Sequence
  chemically synthesized
atttgccagaatccatgctttc

SEQ ID NO: 1400618 - DNA, 22 bp, Artificial Sequence
  chemically synthesized
tggtcagccttctttgaaagca

SEQ ID NO: 1400619 - DNA, 22 bp, Artificial Sequence
  chemically synthesized
gccagaatccatgctttcaaag

SEQ ID NO: 1400620 - DNA, 22 bp, Artificial Sequence
  chemically synthesized
ccagaatccatgctttcaaaga

SEQ ID NO: 1400621 - DNA, 22 bp, Artificial Sequence
  chemically synthesized
cctgtggtcagccttctttgaa

SEQ ID NO: 1400622 - DNA, 22 bp, Artificial Sequence
  chemically synthesized
caaaggctgcctgtggtcagcc

SEQ ID NO: 1400623 - DNA, 22 bp, Artificial Sequence
  chemically synthesized
ccaaaggctgcctgtggtcagc

SEQ ID NO: 1400624 - DNA, 22 bp, Artificial Sequence
  chemically synthesized
tcaaagaaggctgaccacaggc

SEQ ID NO: 1400625 - DNA, 22 bp, Artificial Sequence
  chemically synthesized
caaagaaggctgaccacaggca

SEQ ID NO: 1400626 - DNA, 22 bp, Artificial Sequence
  chemically synthesized
atttccaaaggctgcctgtggt

SEQ ID NO: 1400627 - DNA, 22 bp, Artificial Sequence
  chemically synthesized
aaagaaggctgaccacaggcag

SEQ ID NO: 1400628 - DNA, 22 bp, Artificial Sequence
  chemically synthesized
ataattaatttccaaaggctgc

SEQ ID NO: 1400629 - DNA, 22 bp, Artificial Sequence
  chemically synthesized
aataattaatttccaaaggctg

SEQ ID NO: 1400630 - DNA, 22 bp, Artificial Sequence
  chemically synthesized
accacaggcagcctttggaaat

SEQ ID NO: 1400631 - DNA, 22 bp, Artificial Sequence
  chemically synthesized
tggaaattaattattaagtgta

SEQ ID NO: 1400632 - DNA, 22 bp, Artificial Sequence
  chemically synthesized
tatataataatatacacttaat

SEQ ID NO: 1400633 - DNA, 22 bp, Artificial Sequence
  chemically synthesized
ggaaattaattattaagtgtat

SEQ ID NO: 1400634 - DNA, 22 bp, Artificial Sequence
  chemically synthesized
atatataataatatacacttaa

SEQ ID NO: 1400635 - DNA, 22 bp, Artificial Sequence
  chemically synthesized
gaaattaattattaagtgtata

SEQ ID NO: 1400636 - DNA, 22 bp, Artificial Sequence
  chemically synthesized
tatatataataatatacactta

SEQ ID NO: 1400637 - DNA, 22 bp, Artificial Sequence
  chemically synthesized
attattaagtgtatattattat

SEQ ID NO: 1400638 - DNA, 22 bp, Artificial Sequence
  chemically synthesized
ttaagtgtatattattatatat

SEQ ID NO: 1400639 - DNA, 22 bp, Artificial Sequence
  chemically synthesized
agtgtatattattatatataaa

SEQ ID NO: 1400640 - DNA, 22 bp, Artificial Sequence
  chemically synthesized
cagcatgaaaaggttttatata

SEQ ID NO: 1400641 - DNA, 22 bp, Artificial Sequence
  chemically synthesized
gcagcatgaaaaggttttatat

SEQ ID NO: 1400642 - DNA, 22 bp, Artificial Sequence
  chemically synthesized
ttatatataaaaccttttcatg

SEQ ID NO: 1400643 - DNA, 22 bp, Artificial Sequence
  chemically synthesized
tagtgtttgcagcatgaaaagg

SEQ ID NO: 1400644 - DNA, 22 bp, Artificial Sequence
  chemically synthesized
tatataaaaccttttcatgctg

SEQ ID NO: 1400645 - DNA, 22 bp, Artificial Sequence
  chemically synthesized
cagaaatatattgtagtgtttg

SEQ ID NO: 1400646 - DNA, 22 bp, Artificial Sequence
  chemically synthesized
ttcatgctgcaaacactacaat

SEQ ID NO: 1400647 - DNA, 22 bp, Artificial Sequence
  chemically synthesized
tcatgctgcaaacactacaata

SEQ ID NO: 1400648 - DNA, 22 bp, Artificial Sequence
  chemically synthesized
catgctgcaaacactacaatat

SEQ ID NO: 1400649 - DNA, 22 bp, Artificial Sequence
  chemically synthesized
atgctgcaaacactacaatata

SEQ ID NO: 1400650 - DNA, 22 bp, Artificial Sequence
  chemically synthesized
atattgcagaaatatattgtag

SEQ ID NO: 1400651 - DNA, 22 bp, Artificial Sequence
  chemically synthesized
gttgatattgcagaaatatatt

SEQ ID NO: 1400652 - DNA, 22 bp, Artificial Sequence
  chemically synthesized
agttgatattgcagaaatatat

SEQ ID NO: 1400653 - DNA, 22 bp, Artificial Sequence
  chemically synthesized
caaacactacaatatatttctg

SEQ ID NO: 1400654 - DNA, 22 bp, Artificial Sequence
  chemically synthesized
ttagttgatattgcagaaatat

SEQ ID NO: 1400655 - DNA, 22 bp, Artificial Sequence
  chemically synthesized
caatatatttctgcaatatcaa

SEQ ID NO: 1400656 - DNA, 22 bp, Artificial Sequence
  chemically synthesized
ctgcaatatcaactaagaattt

SEQ ID NO: 1400657 - DNA, 22 bp, Artificial Sequence
  chemically synthesized
tgcaatatcaactaagaatttt

SEQ ID NO: 1400658 - DNA, 22 bp, Artificial Sequence
  chemically synthesized
caatatcaactaagaattttat

SEQ ID NO: 1400659 - DNA, 22 bp, Artificial Sequence
  chemically synthesized
aaatgtaagcatagaaaaagaa

SEQ ID NO: 1400660 - DNA, 22 bp, Artificial Sequence
  chemically synthesized
taaaatgtaagcatagaaaaag

SEQ ID NO: 1400661 - DNA, 22 bp, Artificial Sequence
  chemically synthesized
agaattttattctttttctatg

SEQ ID NO: 1400662 - DNA, 22 bp, Artificial Sequence
  chemically synthesized
ctaaaatgtaagcatagaaaaa

SEQ ID NO: 1400663 - DNA, 22 bp, Artificial Sequence
  chemically synthesized
tctaaaatgtaagcatagaaaa

SEQ ID NO: 1400664 - DNA, 22 bp, Artificial Sequence
  chemically synthesized
ttttctaaaatgtaagcataga

SEQ ID NO: 1400665 - DNA, 22 bp, Artificial Sequence
  chemically synthesized
tattctttttctatgcttacat

SEQ ID NO: 1400666 - DNA, 22 bp, Artificial Sequence
  chemically synthesized
ttattttctaaaatgtaagcat

SEQ ID NO: 1400667 - DNA, 22 bp, Artificial Sequence
  chemically synthesized
attctttttctatgcttacatt

SEQ ID NO: 1400668 - DNA, 22 bp, Artificial Sequence
  chemically synthesized
ttctttttctatgcttacattt

SEQ ID NO: 1400669 - DNA, 22 bp, Artificial Sequence
  chemically synthesized
tttttctatgcttacattttag

SEQ ID NO: 1400670 - DNA, 22 bp, Artificial Sequence
  chemically synthesized
tttctatgcttacattttagaa

SEQ ID NO: 1400671 - DNA, 22 bp, Artificial Sequence
  chemically synthesized
ttctatgcttacattttagaaa

SEQ ID NO: 1400672 - DNA, 22 bp, Artificial Sequence
  chemically synthesized
aaacactgttattttctaaaat

SEQ ID NO: 1400673 - DNA, 22 bp, Artificial Sequence
  chemically synthesized
tctatgcttacattttagaaaa

SEQ ID NO: 1400674 - DNA, 22 bp, Artificial Sequence
  chemically synthesized
aaaacactgttattttctaaaa

SEQ ID NO: 1400675 - DNA, 22 bp, Artificial Sequence
  chemically synthesized
ctatgcttacattttagaaaat

SEQ ID NO: 1400676 - DNA, 22 bp, Artificial Sequence
  chemically synthesized
tatgcttacattttagaaaata

SEQ ID NO: 1400677 - DNA, 22 bp, Artificial Sequence
  chemically synthesized
tgcttacattttagaaaataac

SEQ ID NO: 1400678 - DNA, 22 bp, Artificial Sequence
  chemically synthesized
acttaaaacactgttattttct

SEQ ID NO: 1400679 - DNA, 22 bp, Artificial Sequence
  chemically synthesized
ttgacttaaaacactgttattt

SEQ ID NO: 1400680 - DNA, 22 bp, Artificial Sequence
  chemically synthesized
acattttagaaaataacagtgt

SEQ ID NO: 1400681 - DNA, 22 bp, Artificial Sequence
  chemically synthesized
cattttagaaaataacagtgtt

SEQ ID NO: 1400682 - DNA, 22 bp, Artificial Sequence
  chemically synthesized
tagaaaataacagtgttttaag

SEQ ID NO: 1400683 - DNA, 22 bp, Artificial Sequence
  chemically synthesized
agaaaataacagtgttttaagt

SEQ ID NO: 1400684 - DNA, 22 bp, Artificial Sequence
  chemically synthesized
gaaaataacagtgttttaagtc

SEQ ID NO: 1400685 - DNA, 22 bp, Artificial Sequence
  chemically synthesized
ccatccatgtatgttgttgact

SEQ ID NO: 1400686 - DNA, 22 bp, Artificial Sequence
  chemically synthesized
taagtcaacaacatacatggat

SEQ ID NO: 1400687 - DNA, 22 bp, Artificial Sequence
  chemically synthesized
aagtcaacaacatacatggatg

SEQ ID NO: 1400688 - DNA, 22 bp, Artificial Sequence
  chemically synthesized
agtcaacaacatacatggatgg

SEQ ID NO: 1400689 - DNA, 22 bp, Artificial Sequence
  chemically synthesized
gcataaatattaccatccatgt

SEQ ID NO: 1400690 - DNA, 22 bp, Artificial Sequence
  chemically synthesized
agcataaatattaccatccatg

SEQ ID NO: 1400691 - DNA, 22 bp, Artificial Sequence
  chemically synthesized
tgccatatttagcataaatatt

SEQ ID NO: 1400692 - DNA, 22 bp, Artificial Sequence
  chemically synthesized
ttatgccatatttagcataaat

SEQ ID NO: 1400693 - DNA, 22 bp, Artificial Sequence
  chemically synthesized
gttgttatgccatatttagcat

SEQ ID NO: 1400694 - DNA, 22 bp, Artificial Sequence
  chemically synthesized
ggttgttatgccatatttagca

SEQ ID NO: 1400695 - DNA, 22 bp, Artificial Sequence
  chemically synthesized
tttggttgttatgccatattta

SEQ ID NO: 1400696 - DNA, 22 bp, Artificial Sequence
  chemically synthesized
atgctaaatatggcataacaac

SEQ ID NO: 1400697 - DNA, 22 bp, Artificial Sequence
  chemically synthesized
tgctaaatatggcataacaacc

SEQ ID NO: 1400698 - DNA, 22 bp, Artificial Sequence
  chemically synthesized
aatatggcataacaaccaaata

SEQ ID NO: 1400699 - DNA, 22 bp, Artificial Sequence
  chemically synthesized
aataaaaggagttatttggttg

SEQ ID NO: 1400700 - DNA, 22 bp, Artificial Sequence
  chemically synthesized
tagtatatgggaatctaaataa

SEQ ID NO: 1400701 - DNA, 22 bp, Artificial Sequence
  chemically synthesized
atagtatatgggaatctaaata

SEQ ID NO: 1400702 - DNA, 22 bp, Artificial Sequence
  chemically synthesized
tatagtatatgggaatctaaat

SEQ ID NO: 1400703 - DNA, 22 bp, Artificial Sequence
  chemically synthesized
ttatagtatatgggaatctaaa

SEQ ID NO: 1400704 - DNA, 22 bp, Artificial Sequence
  chemically synthesized
cttttatttagattcccatata

SEQ ID NO: 1400705 - DNA, 22 bp, Artificial Sequence
  chemically synthesized
taagtttttatagtatatggga

SEQ ID NO: 1400706 - DNA, 22 bp, Artificial Sequence
  chemically synthesized
ttatttagattcccatatacta

SEQ ID NO: 1400707 - DNA, 22 bp, Artificial Sequence
  chemically synthesized
tatttagattcccatatactat

SEQ ID NO: 1400708 - DNA, 22 bp, Artificial Sequence
  chemically synthesized
atttagattcccatatactata

SEQ ID NO: 1400709 - DNA, 22 bp, Artificial Sequence
  chemically synthesized
tttagattcccatatactataa

SEQ ID NO: 1400710 - DNA, 22 bp, Artificial Sequence
  chemically synthesized
agattcccatatactataaaaa

SEQ ID NO: 1400711 - DNA, 22 bp, Artificial Sequence
  chemically synthesized
gattcccatatactataaaaac

SEQ ID NO: 1400712 - DNA, 22 bp, Artificial Sequence
  chemically synthesized
tagatgcattgtaagtttttat

SEQ ID NO: 1400713 - DNA, 22 bp, Artificial Sequence
  chemically synthesized
ccatatactataaaaacttaca

SEQ ID NO: 1400714 - DNA, 22 bp, Artificial Sequence
  chemically synthesized
aattgtagatgcattgtaagtt

SEQ ID NO: 1400715 - DNA, 22 bp, Artificial Sequence
  chemically synthesized
ttaaattgtagatgcattgtaa

SEQ ID NO: 1400716 - DNA, 22 bp, Artificial Sequence
  chemically synthesized
attaaattgtagatgcattgta

SEQ ID NO: 1400717 - DNA, 22 bp, Artificial Sequence
  chemically synthesized
tattaaattgtagatgcattgt

SEQ ID NO: 1400718 - DNA, 22 bp, Artificial Sequence
  chemically synthesized
taaaaacttacaatgcatctac

SEQ ID NO: 1400719 - DNA, 22 bp, Artificial Sequence
  chemically synthesized
acaatgcatctacaatttaata

SEQ ID NO: 1400720 - DNA, 22 bp, Artificial Sequence
  chemically synthesized
caatgcatctacaatttaataa

SEQ ID NO: 1400721 - DNA, 22 bp, Artificial Sequence
  chemically synthesized
ataacacatactttattaaatt

SEQ ID NO: 1400722 - DNA, 22 bp, Artificial Sequence
  chemically synthesized
gataacacatactttattaaat

SEQ ID NO: 1400723 - DNA, 22 bp, Artificial Sequence
  chemically synthesized
tttgataacacatactttatta

SEQ ID NO: 1400724 - DNA, 22 bp, Artificial Sequence
  chemically synthesized
caatttaataaagtatgtgtta

SEQ ID NO: 1400725 - DNA, 22 bp, Artificial Sequence
  chemically synthesized
tagtattgtttgataacacata

SEQ ID NO: 1400726 - DNA, 22 bp, Artificial Sequence
  chemically synthesized
atagtattgtttgataacacat

SEQ ID NO: 1400727 - DNA, 22 bp, Artificial Sequence
  chemically synthesized
tatagtattgtttgataacaca

SEQ ID NO: 1400728 - DNA, 22 bp, Artificial Sequence
  chemically synthesized
aataaagtatgtgttatcaaac

SEQ ID NO: 1400729 - DNA, 22 bp, Artificial Sequence
  chemically synthesized
ataaagtatgtgttatcaaaca

SEQ ID NO: 1400730 - DNA, 22 bp, Artificial Sequence
  chemically synthesized
attttatagtattgtttgataa

SEQ ID NO: 1400731 - DNA, 22 bp, Artificial Sequence
  chemically synthesized
ttcattttatagtattgtttga

SEQ ID NO: 1400732 - DNA, 22 bp, Artificial Sequence
  chemically synthesized
caattattcattttatagtatt

SEQ ID NO: 1400733 - DNA, 22 bp, Artificial Sequence
  chemically synthesized
ctacaattattcattttatagt

SEQ ID NO: 1400734 - DNA, 22 bp, Artificial Sequence
  chemically synthesized
tactacaattattcattttata

SEQ ID NO: 1400735 - DNA, 22 bp, Artificial Sequence
  chemically synthesized
tcaaacaatactataaaatgaa

SEQ ID NO: 1400736 - DNA, 22 bp, Artificial Sequence
  chemically synthesized
ctactacaattattcattttat

SEQ ID NO: 1400737 - DNA, 22 bp, Artificial Sequence
  chemically synthesized
gtttctactacaattattcatt

SEQ ID NO: 1400738 - DNA, 22 bp, Artificial Sequence
  chemically synthesized
ggtttctactacaattattcat

SEQ ID NO: 1400739 - DNA, 22 bp, Artificial Sequence
  chemically synthesized
taaaatgaataattgtagtaga

SEQ ID NO: 1400740 - DNA, 22 bp, Artificial Sequence
  chemically synthesized
aaaaagaggggggtaaaacctt

SEQ ID NO: 1400741 - DNA, 22 bp, Artificial Sequence
  chemically synthesized
tagtagaaaccaaggttttacc

SEQ ID NO: 1400742 - DNA, 22 bp, Artificial Sequence
  chemically synthesized
tcaaaaagaggggggtaaaacc

SEQ ID NO: 1400743 - DNA, 22 bp, Artificial Sequence
  chemically synthesized
atgtaaagcataattctcaaaa

SEQ ID NO: 1400744 - DNA, 22 bp, Artificial Sequence
  chemically synthesized
tacccccctctttttgagaatt

SEQ ID NO: 1400745 - DNA, 22 bp, Artificial Sequence
  chemically synthesized
acccccctctttttgagaatta

SEQ ID NO: 1400746 - DNA, 22 bp, Artificial Sequence
  chemically synthesized
cccccctctttttgagaattat

SEQ ID NO: 1400747 - DNA, 22 bp, Artificial Sequence
  chemically synthesized
tttttgagaattatgctttaca

SEQ ID NO: 1400748 - DNA, 22 bp, Artificial Sequence
  chemically synthesized
tttgagaattatgctttacatc

SEQ ID NO: 1400749 - DNA, 22 bp, Artificial Sequence
  chemically synthesized
ttgagaattatgctttacatca

SEQ ID NO: 1400750 - DNA, 22 bp, Artificial Sequence
  chemically synthesized
tgagaattatgctttacatcag

SEQ ID NO: 1400751 - DNA, 22 bp, Artificial Sequence
  chemically synthesized
atggaaggaggactgatgtaaa

SEQ ID NO: 1400752 - DNA, 22 bp, Artificial Sequence
  chemically synthesized
gagaattatgctttacatcagt

SEQ ID NO: 1400753 - DNA, 22 bp, Artificial Sequence
  chemically synthesized
agaattatgctttacatcagtc

SEQ ID NO: 1400754 - DNA, 22 bp, Artificial Sequence
  chemically synthesized
acagactaatggaaggaggact

SEQ ID NO: 1400755 - DNA, 22 bp, Artificial Sequence
  chemically synthesized
tgctttacatcagtcctccttc

SEQ ID NO: 1400756 - DNA, 22 bp, Artificial Sequence
  chemically synthesized
actaacagactaatggaaggag

SEQ ID NO: 1400757 - DNA, 22 bp, Artificial Sequence
  chemically synthesized
aactaacagactaatggaagga

SEQ ID NO: 1400758 - DNA, 22 bp, Artificial Sequence
  chemically synthesized
tacatcagtcctccttccatta

SEQ ID NO: 1400759 - DNA, 22 bp, Artificial Sequence
  chemically synthesized
taactaacagactaatggaagg

SEQ ID NO: 1400760 - DNA, 22 bp, Artificial Sequence
  chemically synthesized
acatcagtcctccttccattag

SEQ ID NO: 1400761 - DNA, 22 bp, Artificial Sequence
  chemically synthesized
ttaactaacagactaatggaag

SEQ ID NO: 1400762 - DNA, 22 bp, Artificial Sequence
  chemically synthesized
catcagtcctccttccattagt

SEQ ID NO: 1400763 - DNA, 22 bp, Artificial Sequence
  chemically synthesized
tttaactaacagactaatggaa

SEQ ID NO: 1400764 - DNA, 22 bp, Artificial Sequence
  chemically synthesized
cttccattagtctgttagttaa

SEQ ID NO: 1400765 - DNA, 22 bp, Artificial Sequence
  chemically synthesized
ccattagtctgttagttaaaaa

SEQ ID NO: 1400766 - DNA, 22 bp, Artificial Sequence
  chemically synthesized
cattagtctgttagttaaaaag

SEQ ID NO: 1400767 - DNA, 22 bp, Artificial Sequence
  chemically synthesized
cagtgacaatatgctttttaac

SEQ ID NO: 1400768 - DNA, 22 bp, Artificial Sequence
  chemically synthesized
gcagtgacaatatgctttttaa

SEQ ID NO: 1400769 - DNA, 22 bp, Artificial Sequence
  chemically synthesized
tgcagtgacaatatgcttttta

SEQ ID NO: 1400770 - DNA, 22 bp, Artificial Sequence
  chemically synthesized
gtctgttagttaaaaagcatat

SEQ ID NO: 1400771 - DNA, 22 bp, Artificial Sequence
  chemically synthesized
attttgcagtgacaatatgctt

SEQ ID NO: 1400772 - DNA, 22 bp, Artificial Sequence
  chemically synthesized
ttagttaaaaagcatattgtca

SEQ ID NO: 1400773 - DNA, 22 bp, Artificial Sequence
  chemically synthesized
gttaaaaagcatattgtcactg

SEQ ID NO: 1400774 - DNA, 22 bp, Artificial Sequence
  chemically synthesized
caattaattttgcagtgacaat

SEQ ID NO: 1400775 - DNA, 22 bp, Artificial Sequence
  chemically synthesized
aaaagcatattgtcactgcaaa

SEQ ID NO: 1400776 - DNA, 22 bp, Artificial Sequence
  chemically synthesized
cataggaaacattacaattaat

SEQ ID NO: 1400777 - DNA, 22 bp, Artificial Sequence
  chemically synthesized
tcactgcaaaattaattgtaat

SEQ ID NO: 1400778 - DNA, 22 bp, Artificial Sequence
  chemically synthesized
tgtctgcataggaaacattaca

SEQ ID NO: 1400779 - DNA, 22 bp, Artificial Sequence
  chemically synthesized
caaaattaattgtaatgtttcc

SEQ ID NO: 1400780 - DNA, 22 bp, Artificial Sequence
  chemically synthesized
agcactatgtctgcataggaaa

SEQ ID NO: 1400781 - DNA, 22 bp, Artificial Sequence
  chemically synthesized
attgtaatgtttcctatgcaga

SEQ ID NO: 1400782 - DNA, 22 bp, Artificial Sequence
  chemically synthesized
ttaagcactatgtctgcatagg

SEQ ID NO: 1400783 - DNA, 22 bp, Artificial Sequence
  chemically synthesized
tattaagcactatgtctgcata

SEQ ID NO: 1400784 - DNA, 22 bp, Artificial Sequence
  chemically synthesized
taatgtttcctatgcagacata

SEQ ID NO: 1400785 - DNA, 22 bp, Artificial Sequence
  chemically synthesized
cctatgcagacatagtgcttaa

SEQ ID NO: 1400786 - DNA, 22 bp, Artificial Sequence
  chemically synthesized
ctatgcagacatagtgcttaat

SEQ ID NO: 1400787 - DNA, 22 bp, Artificial Sequence
  chemically synthesized
agacagtgggctctattaagca

SEQ ID NO: 1400788 - DNA, 22 bp, Artificial Sequence
  chemically synthesized
tgcagacatagtgcttaataga

SEQ ID NO: 1400789 - DNA, 22 bp, Artificial Sequence
  chemically synthesized
ttgagacagtgggctctattaa

SEQ ID NO: 1400790 - DNA, 22 bp, Artificial Sequence
  chemically synthesized
tattgagacagtgggctctatt

SEQ ID NO: 1400791 - DNA, 22 bp, Artificial Sequence
  chemically synthesized
ctattgagacagtgggctctat

SEQ ID NO: 1400792 - DNA, 22 bp, Artificial Sequence
  chemically synthesized
tctattgagacagtgggctcta

SEQ ID NO: 1400793 - DNA, 22 bp, Artificial Sequence
  chemically synthesized
ttctattgagacagtgggctct

SEQ ID NO: 1400794 - DNA, 22 bp, Artificial Sequence
  chemically synthesized
cttttctattgagacagtgggc

SEQ ID NO: 1400795 - DNA, 22 bp, Artificial Sequence
  chemically synthesized
aatagagcccactgtctcaata

SEQ ID NO: 1400796 - DNA, 22 bp, Artificial Sequence
  chemically synthesized
atagagcccactgtctcaatag

SEQ ID NO: 1400797 - DNA, 22 bp, Artificial Sequence
  chemically synthesized
gacagattccttttctattgag

SEQ ID NO: 1400798 - DNA, 22 bp, Artificial Sequence
  chemically synthesized
aaactagacagattccttttct

SEQ ID NO: 1400799 - DNA, 22 bp, Artificial Sequence
  chemically synthesized
gctgaaactagacagattcctt

SEQ ID NO: 1400800 - DNA, 22 bp, Artificial Sequence
  chemically synthesized
tctcaatagaaaaggaatctgt

SEQ ID NO: 1400801 - DNA, 22 bp, Artificial Sequence
  chemically synthesized
ggctgaaactagacagattcct

SEQ ID NO: 1400802 - DNA, 22 bp, Artificial Sequence
  chemically synthesized
aatagaaaaggaatctgtctag

SEQ ID NO: 1400803 - DNA, 22 bp, Artificial Sequence
  chemically synthesized
aataaatttggctgaaactaga

SEQ ID NO: 1400804 - DNA, 22 bp, Artificial Sequence
  chemically synthesized
taaataaatttggctgaaacta

SEQ ID NO: 1400805 - DNA, 22 bp, Artificial Sequence
  chemically synthesized
actctaaataaatttggctgaa

SEQ ID NO: 1400806 - DNA, 22 bp, Artificial Sequence
  chemically synthesized
tctgactctaaataaatttggc

SEQ ID NO: 1400807 - DNA, 22 bp, Artificial Sequence
  chemically synthesized
atctgactctaaataaatttgg

SEQ ID NO: 1400808 - DNA, 22 bp, Artificial Sequence
  chemically synthesized
tctagtttcagccaaatttatt

SEQ ID NO: 1400809 - DNA, 22 bp, Artificial Sequence
  chemically synthesized
gtttcagccaaatttatttaga

SEQ ID NO: 1400810 - DNA, 22 bp, Artificial Sequence
  chemically synthesized
cagccaaatttatttagagtca

SEQ ID NO: 1400811 - DNA, 22 bp, Artificial Sequence
  chemically synthesized
atcaaatttatctgactctaaa

SEQ ID NO: 1400812 - DNA, 22 bp, Artificial Sequence
  chemically synthesized
agccaaatttatttagagtcag

SEQ ID NO: 1400813 - DNA, 22 bp, Artificial Sequence
  chemically synthesized
aatcaaatttatctgactctaa

SEQ ID NO: 1400814 - DNA, 22 bp, Artificial Sequence
  chemically synthesized
tgtttaatcaaatttatctgac

SEQ ID NO: 1400815 - DNA, 22 bp, Artificial Sequence
  chemically synthesized
atgtttaatcaaatttatctga

SEQ ID NO: 1400816 - DNA, 22 bp, Artificial Sequence
  chemically synthesized
tatgtttaatcaaatttatctg

SEQ ID NO: 1400817 - DNA, 22 bp, Artificial Sequence
  chemically synthesized
atttagagtcagataaatttga

SEQ ID NO: 1400818 - DNA, 22 bp, Artificial Sequence
  chemically synthesized
ttttatgtttaatcaaatttat

SEQ ID NO: 1400819 - DNA, 22 bp, Artificial Sequence
  chemically synthesized
tttagagtcagataaatttgat

SEQ ID NO: 1400820 - DNA, 22 bp, Artificial Sequence
  chemically synthesized
gttttatgtttaatcaaattta

SEQ ID NO: 1400821 - DNA, 22 bp, Artificial Sequence
  chemically synthesized
agagtcagataaatttgattaa

SEQ ID NO: 1400822 - DNA, 22 bp, Artificial Sequence
  chemically synthesized
gagtcagataaatttgattaaa

SEQ ID NO: 1400823 - DNA, 22 bp, Artificial Sequence
  chemically synthesized
aatatggatacttgttttatgt

SEQ ID NO: 1400824 - DNA, 22 bp, Artificial Sequence
  chemically synthesized
gattaaacataaaacaagtatc

SEQ ID NO: 1400825 - DNA, 22 bp, Artificial Sequence
  chemically synthesized
attaaacataaaacaagtatcc

SEQ ID NO: 1400826 - DNA, 22 bp, Artificial Sequence
  chemically synthesized
aggtgttcaatatggatacttg

SEQ ID NO: 1400827 - DNA, 22 bp, Artificial Sequence
  chemically synthesized
aacataaaacaagtatccatat

SEQ ID NO: 1400828 - DNA, 22 bp, Artificial Sequence
  chemically synthesized
ggtaactgaggtgttcaatatg

SEQ ID NO: 1400829 - DNA, 22 bp, Artificial Sequence
  chemically synthesized
taaaggattaggtaactgaggt

SEQ ID NO: 1400830 - DNA, 22 bp, Artificial Sequence
  chemically synthesized
gactgtaaaggattaggtaact

SEQ ID NO: 1400831 - DNA, 22 bp, Artificial Sequence
  chemically synthesized
aacacctcagttacctaatcct

SEQ ID NO: 1400832 - DNA, 22 bp, Artificial Sequence
  chemically synthesized
ataatggactagactgtaaagg

SEQ ID NO: 1400833 - DNA, 22 bp, Artificial Sequence
  chemically synthesized
agttacctaatcctttacagtc

SEQ ID NO: 1400834 - DNA, 22 bp, Artificial Sequence
  chemically synthesized
ttaataatggactagactgtaa

SEQ ID NO: 1400835 - DNA, 22 bp, Artificial Sequence
  chemically synthesized
cctaatcctttacagtctagtc

SEQ ID NO: 1400836 - DNA, 22 bp, Artificial Sequence
  chemically synthesized
atactgttaataatggactaga

SEQ ID NO: 1400837 - DNA, 22 bp, Artificial Sequence
  chemically synthesized
atcctttacagtctagtccatt

SEQ ID NO: 1400838 - DNA, 22 bp, Artificial Sequence
  chemically synthesized
aatactgttaataatggactag

SEQ ID NO: 1400839 - DNA, 22 bp, Artificial Sequence
  chemically synthesized
tacagtctagtccattattaac

SEQ ID NO: 1400840 - DNA, 22 bp, Artificial Sequence
  chemically synthesized
acagtctagtccattattaaca

SEQ ID NO: 1400841 - DNA, 22 bp, Artificial Sequence
  chemically synthesized
tgatcttaatactgttaataat

SEQ ID NO: 1400842 - DNA, 22 bp, Artificial Sequence
  chemically synthesized
cagtctagtccattattaacag

SEQ ID NO: 1400843 - DNA, 22 bp, Artificial Sequence
  chemically synthesized
atgatcttaatactgttaataa

SEQ ID NO: 1400844 - DNA, 22 bp, Artificial Sequence
  chemically synthesized
gtccattattaacagtattaag

SEQ ID NO: 1400845 - DNA, 22 bp, Artificial Sequence
  chemically synthesized
atcccttatgatcttaatactg

SEQ ID NO: 1400846 - DNA, 22 bp, Artificial Sequence
  chemically synthesized
ttaatcccttatgatcttaata

SEQ ID NO: 1400847 - DNA, 22 bp, Artificial Sequence
  chemically synthesized
attaatcccttatgatcttaat

SEQ ID NO: 1400848 - DNA, 22 bp, Artificial Sequence
  chemically synthesized
tattaatcccttatgatcttaa

SEQ ID NO: 1400849 - DNA, 22 bp, Artificial Sequence
  chemically synthesized
ttaacagtattaagatcataag

SEQ ID NO: 1400850 - DNA, 22 bp, Artificial Sequence
  chemically synthesized
acagtattaagatcataaggga

SEQ ID NO: 1400851 - DNA, 22 bp, Artificial Sequence
  chemically synthesized
tagaaactttattaatccctta

SEQ ID NO: 1400852 - DNA, 22 bp, Artificial Sequence
  chemically synthesized
tgtagaaactttattaatccct

SEQ ID NO: 1400853 - DNA, 22 bp, Artificial Sequence
  chemically synthesized
ctgtagaaactttattaatccc

SEQ ID NO: 1400854 - DNA, 22 bp, Artificial Sequence
  chemically synthesized
agatcataagggattaataaag

SEQ ID NO: 1400855 - DNA, 22 bp, Artificial Sequence
  chemically synthesized
ccttctgtagaaactttattaa

SEQ ID NO: 1400856 - DNA, 22 bp, Artificial Sequence
  chemically synthesized
ataaagtttctacagaagggaa

SEQ ID NO: 1400857 - DNA, 22 bp, Artificial Sequence
  chemically synthesized
aaatcagacaagggaaaatgtt

SEQ ID NO: 1400858 - DNA, 22 bp, Artificial Sequence
  chemically synthesized
ctacagaagggaacattttccc

SEQ ID NO: 1400859 - DNA, 22 bp, Artificial Sequence
  chemically synthesized
tacagaagggaacattttccct

SEQ ID NO: 1400860 - DNA, 22 bp, Artificial Sequence
  chemically synthesized
ctgaaatcagacaagggaaaat

SEQ ID NO: 1400861 - DNA, 22 bp, Artificial Sequence
  chemically synthesized
cagaagggaacattttcccttg

SEQ ID NO: 1400862 - DNA, 22 bp, Artificial Sequence
  chemically synthesized
actgaaatcagacaagggaaaa

SEQ ID NO: 1400863 - DNA, 22 bp, Artificial Sequence
  chemically synthesized
tactgaaatcagacaagggaaa

SEQ ID NO: 1400864 - DNA, 22 bp, Artificial Sequence
  chemically synthesized
ctttactgaaatcagacaaggg

SEQ ID NO: 1400865 - DNA, 22 bp, Artificial Sequence
  chemically synthesized
tatgctcctttactgaaatcag

SEQ ID NO: 1400866 - DNA, 22 bp, Artificial Sequence
  chemically synthesized
tcccttgtctgatttcagtaaa

SEQ ID NO: 1400867 - DNA, 22 bp, Artificial Sequence
  chemically synthesized
cccttgtctgatttcagtaaag

SEQ ID NO: 1400868 - DNA, 22 bp, Artificial Sequence
  chemically synthesized
ccttgtctgatttcagtaaagg

SEQ ID NO: 1400869 - DNA, 22 bp, Artificial Sequence
  chemically synthesized
tcaaagctatatgctcctttac

SEQ ID NO: 1400870 - DNA, 22 bp, Artificial Sequence
  chemically synthesized
gtctgatttcagtaaaggagca

SEQ ID NO: 1400871 - DNA, 22 bp, Artificial Sequence
  chemically synthesized
atcaaagctatatgctccttta

SEQ ID NO: 1400872 - DNA, 22 bp, Artificial Sequence
  chemically synthesized
tctgatttcagtaaaggagcat

SEQ ID NO: 1400873 - DNA, 22 bp, Artificial Sequence
  chemically synthesized
tatcaaagctatatgctccttt

SEQ ID NO: 1400874 - DNA, 22 bp, Artificial Sequence
  chemically synthesized
atttcagtaaaggagcatatag

SEQ ID NO: 1400875 - DNA, 22 bp, Artificial Sequence
  chemically synthesized
attttatcaaagctatatgctc

SEQ ID NO: 1400876 - DNA, 22 bp, Artificial Sequence
  chemically synthesized
cattttatcaaagctatatgct

SEQ ID NO: 1400877 - DNA, 22 bp, Artificial Sequence
  chemically synthesized
cagtaaaggagcatatagcttt

SEQ ID NO: 1400878 - DNA, 22 bp, Artificial Sequence
  chemically synthesized
agtaaaggagcatatagctttg

SEQ ID NO: 1400879 - DNA, 22 bp, Artificial Sequence
  chemically synthesized
gaaaatgatgatgatgatttca

SEQ ID NO: 1400880 - DNA, 22 bp, Artificial Sequence
  chemically synthesized
agaaaatgatgatgatgatttc

SEQ ID NO: 1400881 - DNA, 22 bp, Artificial Sequence
  chemically synthesized
tagaaaatgatgatgatgattt

SEQ ID NO: 1400882 - DNA, 22 bp, Artificial Sequence
  chemically synthesized
tgataaaatgaaatcatcatca

SEQ ID NO: 1400883 - DNA, 22 bp, Artificial Sequence
  chemically synthesized
gataaaatgaaatcatcatcat

SEQ ID NO: 1400884 - DNA, 22 bp, Artificial Sequence
  chemically synthesized
ataaaatgaaatcatcatcatc

SEQ ID NO: 1400885 - DNA, 22 bp, Artificial Sequence
  chemically synthesized
tctaaaatattctttatgtttt

SEQ ID NO: 1400886 - DNA, 22 bp, Artificial Sequence
  chemically synthesized
ctaaaatattctttatgtttta

SEQ ID NO: 1400887 - DNA, 22 bp, Artificial Sequence
  chemically synthesized
taaaatattctttatgttttat

SEQ ID NO: 1400888 - DNA, 22 bp, Artificial Sequence
  chemically synthesized
aaatattctttatgttttatgt

SEQ ID NO: 1400889 - DNA, 22 bp, Artificial Sequence
  chemically synthesized
tttatgttttatgtttcttggg

SEQ ID NO: 1400890 - DNA, 22 bp, Artificial Sequence
  chemically synthesized
tatgttttatgtttcttgggct

SEQ ID NO: 1400891 - DNA, 22 bp, Artificial Sequence
  chemically synthesized
atcagcacagtaagcccaagaa

SEQ ID NO: 1400892 - DNA, 22 bp, Artificial Sequence
  chemically synthesized
atgttttatgtttcttgggctt

SEQ ID NO: 1400893 - DNA, 22 bp, Artificial Sequence
  chemically synthesized
aatcagcacagtaagcccaaga

SEQ ID NO: 1400894 - DNA, 22 bp, Artificial Sequence
  chemically synthesized
tgttttatgtttcttgggctta

SEQ ID NO: 1400895 - DNA, 22 bp, Artificial Sequence
  chemically synthesized
cacttaatcagcacagtaagcc

SEQ ID NO: 1400896 - DNA, 22 bp, Artificial Sequence
  chemically synthesized
tatgtttcttgggcttactgtg

SEQ ID NO: 1400897 - DNA, 22 bp, Artificial Sequence
  chemically synthesized
atgtttcttgggcttactgtgc

SEQ ID NO: 1400898 - DNA, 22 bp, Artificial Sequence
  chemically synthesized
tgtttcttgggcttactgtgct

SEQ ID NO: 1400899 - DNA, 22 bp, Artificial Sequence
  chemically synthesized
tcactccacttaatcagcacag

SEQ ID NO: 1400900 - DNA, 22 bp, Artificial Sequence
  chemically synthesized
cttgggcttactgtgctgatta

SEQ ID NO: 1400901 - DNA, 22 bp, Artificial Sequence
  chemically synthesized
ttgggcttactgtgctgattaa

SEQ ID NO: 1400902 - DNA, 22 bp, Artificial Sequence
  chemically synthesized
gggcttactgtgctgattaagt

SEQ ID NO: 1400903 - DNA, 22 bp, Artificial Sequence
  chemically synthesized
ggcttactgtgctgattaagtg

SEQ ID NO: 1400904 - DNA, 22 bp, Artificial Sequence
  chemically synthesized
actgtgctgattaagtggagtg

SEQ ID NO: 1400905 - DNA, 22 bp, Artificial Sequence
  chemically synthesized
ctgtgctgattaagtggagtga

SEQ ID NO: 1400906 - DNA, 22 bp, Artificial Sequence
  chemically synthesized
tgctgattaagtggagtgataa

SEQ ID NO: 1400907 - DNA, 22 bp, Artificial Sequence
  chemically synthesized
attaagtggagtgataacatat

SEQ ID NO: 1400908 - DNA, 22 bp, Artificial Sequence
  chemically synthesized
agtggagtgataacatattgca

SEQ ID NO: 1400909 - DNA, 22 bp, Artificial Sequence
  chemically synthesized
agtggagtgataaggtaccagt

SEQ ID NO: 1400910 - DNA, 22 bp, Artificial Sequence
  chemically synthesized
attaagtggagtgataaggtac

SEQ ID NO: 1400911 - DNA, 22 bp, Artificial Sequence
  chemically synthesized
tattgattaagtggagtgataa

SEQ ID NO: 1400912 - DNA, 22 bp, Artificial Sequence
  chemically synthesized
cactggtaccttatcactccac

SEQ ID NO: 1400913 - DNA, 22 bp, Artificial Sequence
  chemically synthesized
ctgtattgattaagtggagtga

SEQ ID NO: 1400914 - DNA, 22 bp, Artificial Sequence
  chemically synthesized
ttactgtattgattaagtggag

SEQ ID NO: 1400915 - DNA, 22 bp, Artificial Sequence
  chemically synthesized
gtaccttatcactccacttaat

SEQ ID NO: 1400916 - DNA, 22 bp, Artificial Sequence
  chemically synthesized
tattactgtattgattaagtgg

SEQ ID NO: 1400917 - DNA, 22 bp, Artificial Sequence
  chemically synthesized
atcactccacttaatcaataca

SEQ ID NO: 1400918 - DNA, 22 bp, Artificial Sequence
  chemically synthesized
tcactccacttaatcaatacag

SEQ ID NO: 1400919 - DNA, 22 bp, Artificial Sequence
  chemically synthesized
atagctctattactgtattgat

SEQ ID NO: 1400920 - DNA, 22 bp, Artificial Sequence
  chemically synthesized
cacttaatcaatacagtaatag

SEQ ID NO: 1400921 - DNA, 22 bp, Artificial Sequence
  chemically synthesized
aaactaatagctctattactgt

SEQ ID NO: 1400922 - DNA, 22 bp, Artificial Sequence
  chemically synthesized
aatcaatacagtaatagagcta

SEQ ID NO: 1400923 - DNA, 22 bp, Artificial Sequence
  chemically synthesized
atcaatacagtaatagagctat

SEQ ID NO: 1400924 - DNA, 22 bp, Artificial Sequence
  chemically synthesized
ggattcaaactaatagctctat

SEQ ID NO: 1400925 - DNA, 22 bp, Artificial Sequence
  chemically synthesized
aggattcaaactaatagctcta

SEQ ID NO: 1400926 - DNA, 22 bp, Artificial Sequence
  chemically synthesized
taggattcaaactaatagctct

SEQ ID NO: 1400927 - DNA, 22 bp, Artificial Sequence
  chemically synthesized
ttaggattcaaactaatagctc

SEQ ID NO: 1400928 - DNA, 22 bp, Artificial Sequence
  chemically synthesized
ttagtttgaatcctaaaaactt

SEQ ID NO: 1400929 - DNA, 22 bp, Artificial Sequence
  chemically synthesized
accaaaaaatgataagttttta

SEQ ID NO: 1400930 - DNA, 22 bp, Artificial Sequence
  chemically synthesized
gaccaaaaaatgataagttttt

SEQ ID NO: 1400931 - DNA, 22 bp, Artificial Sequence
  chemically synthesized
gtttgaatcctaaaaacttatc

SEQ ID NO: 1400932 - DNA, 22 bp, Artificial Sequence
  chemically synthesized
tgaccaaaaaatgataagtttt

SEQ ID NO: 1400933 - DNA, 22 bp, Artificial Sequence
  chemically synthesized
gaatcctaaaaacttatcattt

SEQ ID NO: 1400934 - DNA, 22 bp, Artificial Sequence
  chemically synthesized
aatcctaaaaacttatcatttt

SEQ ID NO: 1400935 - DNA, 22 bp, Artificial Sequence
  chemically synthesized
gtccattttgaccaaaaaatga

SEQ ID NO: 1400936 - DNA, 22 bp, Artificial Sequence
  chemically synthesized
aaaacttatcattttttggtca

SEQ ID NO: 1400937 - DNA, 22 bp, Artificial Sequence
  chemically synthesized
atattggtccattttgaccaaa

SEQ ID NO: 1400938 - DNA, 22 bp, Artificial Sequence
  chemically synthesized
ctgatattggtccattttgacc

SEQ ID NO: 1400939 - DNA, 22 bp, Artificial Sequence
  chemically synthesized
gctgatattggtccattttgac

SEQ ID NO: 1400940 - DNA, 22 bp, Artificial Sequence
  chemically synthesized
atcattttttggtcaaaatgga

SEQ ID NO: 1400941 - DNA, 22 bp, Artificial Sequence
  chemically synthesized
tcattttttggtcaaaatggac

SEQ ID NO: 1400942 - DNA, 22 bp, Artificial Sequence
  chemically synthesized
tttggtcaaaatggaccaatat

SEQ ID NO: 1400943 - DNA, 22 bp, Artificial Sequence
  chemically synthesized
ttggtcaaaatggaccaatatc

SEQ ID NO: 1400944 - DNA, 22 bp, Artificial Sequence
  chemically synthesized
tggtcaaaatggaccaatatca

SEQ ID NO: 1400945 - DNA, 22 bp, Artificial Sequence
  chemically synthesized
ggtcaaaatggaccaatatcag

SEQ ID NO: 1400946 - DNA, 22 bp, Artificial Sequence
  chemically synthesized
gtcaaaatggaccaatatcagc

SEQ ID NO: 1400947 - DNA, 22 bp, Artificial Sequence
  chemically synthesized
aatcatatgaatttgctgatat

SEQ ID NO: 1400948 - DNA, 22 bp, Artificial Sequence
  chemically synthesized
agatagatacatagattgaatc

SEQ ID NO: 1400949 - DNA, 22 bp, Artificial Sequence
  chemically synthesized
atatgattcaatctatgtatct

SEQ ID NO: 1400950 - DNA, 22 bp, Artificial Sequence
  chemically synthesized
catatatacctaagatagatac

SEQ ID NO: 1400951 - DNA, 22 bp, Artificial Sequence
  chemically synthesized
aatctatgtatctatcttaggt

SEQ ID NO: 1400952 - DNA, 22 bp, Artificial Sequence
  chemically synthesized
tgtatctatcttaggtatatat

SEQ ID NO: 1400953 - DNA, 22 bp, Artificial Sequence
  chemically synthesized
atacgccactccatatatacct

SEQ ID NO: 1400954 - DNA, 22 bp, Artificial Sequence
  chemically synthesized
ttcatacgccactccatatata

SEQ ID NO: 1400955 - DNA, 22 bp, Artificial Sequence
  chemically synthesized
attcatacgccactccatatat

SEQ ID NO: 1400956 - DNA, 22 bp, Artificial Sequence
  chemically synthesized
tttattcatacgccactccata

SEQ ID NO: 1400957 - DNA, 22 bp, Artificial Sequence
  chemically synthesized
tcttaggtatatatggagtggc

SEQ ID NO: 1400958 - DNA, 22 bp, Artificial Sequence
  chemically synthesized
aggtatatatggagtggcgtat

SEQ ID NO: 1400959 - DNA, 22 bp, Artificial Sequence
  chemically synthesized
ggtatatatggagtggcgtatg

SEQ ID NO: 1400960 - DNA, 22 bp, Artificial Sequence
  chemically synthesized
atcaaatcatatatatatctgt

SEQ ID NO: 1400961 - DNA, 22 bp, Artificial Sequence
  chemically synthesized
actcatcaaatcatatatatat

SEQ ID NO: 1400962 - DNA, 22 bp, Artificial Sequence
  chemically synthesized
aactcatcaaatcatatatata

SEQ ID NO: 1400963 - DNA, 22 bp, Artificial Sequence
  chemically synthesized
ttaactcatcaaatcatatata

SEQ ID NO: 1400964 - DNA, 22 bp, Artificial Sequence
  chemically synthesized
ttcttaactcatcaaatcatat

SEQ ID NO: 1400965 - DNA, 22 bp, Artificial Sequence
  chemically synthesized
gacccaattattcttaactcat

SEQ ID NO: 1400966 - DNA, 22 bp, Artificial Sequence
  chemically synthesized
tggacccaattattcttaactc

SEQ ID NO: 1400967 - DNA, 22 bp, Artificial Sequence
  chemically synthesized
tctggacccaattattcttaac

SEQ ID NO: 1400968 - DNA, 22 bp, Artificial Sequence
  chemically synthesized
ctctggacccaattattcttaa

SEQ ID NO: 1400969 - DNA, 22 bp, Artificial Sequence
  chemically synthesized
tttctctggacccaattattct

SEQ ID NO: 1400970 - DNA, 22 bp, Artificial Sequence
  chemically synthesized
atttctctggacccaattattc

SEQ ID NO: 1400971 - DNA, 22 bp, Artificial Sequence
  chemically synthesized
tatttctctggacccaattatt

SEQ ID NO: 1400972 - DNA, 22 bp, Artificial Sequence
  chemically synthesized
gatgagttaagaataattgggt

SEQ ID NO: 1400973 - DNA, 22 bp, Artificial Sequence
  chemically synthesized
atgagttaagaataattgggtc

SEQ ID NO: 1400974 - DNA, 22 bp, Artificial Sequence
  chemically synthesized
gagaactttatttctctggacc

SEQ ID NO: 1400975 - DNA, 22 bp, Artificial Sequence
  chemically synthesized
agaataattgggtccagagaaa

SEQ ID NO: 1400976 - DNA, 22 bp, Artificial Sequence
  chemically synthesized
ggtccagagaaataaagttctc

SEQ ID NO: 1400977 - DNA, 22 bp, Artificial Sequence
  chemically synthesized
agtagaacagtggtgcctagag

SEQ ID NO: 1400978 - DNA, 22 bp, Artificial Sequence
  chemically synthesized
cagtagaacagtggtgcctaga

SEQ ID NO: 1400979 - DNA, 22 bp, Artificial Sequence
  chemically synthesized
tttcagtagaacagtggtgcct

SEQ ID NO: 1400980 - DNA, 22 bp, Artificial Sequence
  chemically synthesized
attgtttcagtagaacagtggt

SEQ ID NO: 1400981 - DNA, 22 bp, Artificial Sequence
  chemically synthesized
tctaggcaccactgttctactg

SEQ ID NO: 1400982 - DNA, 22 bp, Artificial Sequence
  chemically synthesized
taggcaccactgttctactgaa

SEQ ID NO: 1400983 - DNA, 22 bp, Artificial Sequence
  chemically synthesized
ggcaccactgttctactgaaac

SEQ ID NO: 1400984 - DNA, 22 bp, Artificial Sequence
  chemically synthesized
ttctactgaaacaattaatttg

SEQ ID NO: 1400985 - DNA, 22 bp, Artificial Sequence
  chemically synthesized
tactgaaacaattaatttgttt

SEQ ID NO: 1400986 - DNA, 22 bp, Artificial Sequence
  chemically synthesized
ctgaaacaattaatttgttttg

SEQ ID NO: 1400987 - DNA, 22 bp, Artificial Sequence
  chemically synthesized
aaacaattaatttgttttgatc

SEQ ID NO: 1400988 - DNA, 22 bp, Artificial Sequence
  chemically synthesized
atcgaacatgtatataaagatc

SEQ ID NO: 1400989 - DNA, 22 bp, Artificial Sequence
  chemically synthesized
atttgttttgatctttatatac

SEQ ID NO: 1400990 - DNA, 22 bp, Artificial Sequence
  chemically synthesized
gttttgatctttatatacatgt

SEQ ID NO: 1400991 - DNA, 22 bp, Artificial Sequence
  chemically synthesized
ttttgatctttatatacatgtt

SEQ ID NO: 1400992 - DNA, 22 bp, Artificial Sequence
  chemically synthesized
aatcatctaatcgaacatgtat

SEQ ID NO: 1400993 - DNA, 22 bp, Artificial Sequence
  chemically synthesized
aaatcatctaatcgaacatgta

SEQ ID NO: 1400994 - DNA, 22 bp, Artificial Sequence
  chemically synthesized
tgatctttatatacatgttcga

SEQ ID NO: 1400995 - DNA, 22 bp, Artificial Sequence
  chemically synthesized
taaatcatctaatcgaacatgt

SEQ ID NO: 1400996 - DNA, 22 bp, Artificial Sequence
  chemically synthesized
gatctttatatacatgttcgat

SEQ ID NO: 1400997 - DNA, 22 bp, Artificial Sequence
  chemically synthesized
atctttatatacatgttcgatt

SEQ ID NO: 1400998 - DNA, 22 bp, Artificial Sequence
  chemically synthesized
aaattttaaatcatctaatcga

SEQ ID NO: 1400999 - DNA, 22 bp, Artificial Sequence
  chemically synthesized
tatatacatgttcgattagatg

SEQ ID NO: 1401000 - DNA, 22 bp, Artificial Sequence
  chemically synthesized
aaaattttaaatcatctaatcg

SEQ ID NO: 1401001 - DNA, 22 bp, Artificial Sequence
  chemically synthesized
atatacatgttcgattagatga

SEQ ID NO: 1401002 - DNA, 22 bp, Artificial Sequence
  chemically synthesized
taaaattttaaatcatctaatc

SEQ ID NO: 1401003 - DNA, 22 bp, Artificial Sequence
  chemically synthesized
tatacatgttcgattagatgat

SEQ ID NO: 1401004 - DNA, 22 bp, Artificial Sequence
  chemically synthesized
atactttaaaattttaaatcat

SEQ ID NO: 1401005 - DNA, 22 bp, Artificial Sequence
  chemically synthesized
aatactttaaaattttaaatca

SEQ ID NO: 1401006 - DNA, 22 bp, Artificial Sequence
  chemically synthesized
taatactttaaaattttaaatc

SEQ ID NO: 1401007 - DNA, 22 bp, Artificial Sequence
  chemically synthesized
ttaatactttaaaattttaaat

SEQ ID NO: 1401008 - DNA, 22 bp, Artificial Sequence
  chemically synthesized
gattagatgatttaaaatttta

SEQ ID NO: 1401009 - DNA, 22 bp, Artificial Sequence
  chemically synthesized
aacttttaatactttaaaattt

SEQ ID NO: 1401010 - DNA, 22 bp, Artificial Sequence
  chemically synthesized
aaacttttaatactttaaaatt

SEQ ID NO: 1401011 - DNA, 22 bp, Artificial Sequence
  chemically synthesized
taaacttttaatactttaaaat

SEQ ID NO: 1401012 - DNA, 22 bp, Artificial Sequence
  chemically synthesized
gatgatttaaaattttaaagta

SEQ ID NO: 1401013 - DNA, 22 bp, Artificial Sequence
  chemically synthesized
ttaaacttttaatactttaaaa

SEQ ID NO: 1401014 - DNA, 22 bp, Artificial Sequence
  chemically synthesized
gtttttaaacttttaatacttt

SEQ ID NO: 1401015 - DNA, 22 bp, Artificial Sequence
  chemically synthesized
aaaattttaaagtattaaaagt

SEQ ID NO: 1401016 - DNA, 22 bp, Artificial Sequence
  chemically synthesized
aaattttaaagtattaaaagtt

SEQ ID NO: 1401017 - DNA, 22 bp, Artificial Sequence
  chemically synthesized
aaactagtttttaaacttttaa

SEQ ID NO: 1401018 - DNA, 22 bp, Artificial Sequence
  chemically synthesized
aaaactagtttttaaactttta

SEQ ID NO: 1401019 - DNA, 22 bp, Artificial Sequence
  chemically synthesized
taaaactagtttttaaactttt

SEQ ID NO: 1401020 - DNA, 22 bp, Artificial Sequence
  chemically synthesized
ttaaaactagtttttaaacttt

SEQ ID NO: 1401021 - DNA, 22 bp, Artificial Sequence
  chemically synthesized
taaagtattaaaagtttaaaaa

SEQ ID NO: 1401022 - DNA, 22 bp, Artificial Sequence
  chemically synthesized
aaagtattaaaagtttaaaaac

SEQ ID NO: 1401023 - DNA, 22 bp, Artificial Sequence
  chemically synthesized
aagtattaaaagtttaaaaact

SEQ ID NO: 1401024 - DNA, 22 bp, Artificial Sequence
  chemically synthesized
aaaaaacttttaaaactagttt

SEQ ID NO: 1401025 - DNA, 22 bp, Artificial Sequence
  chemically synthesized
aaaaaaacttttaaaactagtt

SEQ ID NO: 1401026 - DNA, 22 bp, Artificial Sequence
  chemically synthesized
taaaaaaacttttaaaactagt

SEQ ID NO: 1401027 - DNA, 22 bp, Artificial Sequence
  chemically synthesized
aaagtttaaaaactagttttaa

SEQ ID NO: 1401028 - DNA, 22 bp, Artificial Sequence
  chemically synthesized
aaaaactagttttaaaagtttt

SEQ ID NO: 1401029 - DNA, 22 bp, Artificial Sequence
  chemically synthesized
aaaactagttttaaaagttttt

SEQ ID NO: 1401030 - DNA, 22 bp, Artificial Sequence
  chemically synthesized
gttttaaaagtttttttaaaat

SEQ ID NO: 1401031 - DNA, 22 bp, Artificial Sequence
  chemically synthesized
aatgtgtaaacatcattttaaa

SEQ ID NO: 1401032 - DNA, 22 bp, Artificial Sequence
  chemically synthesized
taaaagtttttttaaaatgatg

SEQ ID NO: 1401033 - DNA, 22 bp, Artificial Sequence
  chemically synthesized
aaaagtttttttaaaatgatgt

SEQ ID NO: 1401034 - DNA, 22 bp, Artificial Sequence
  chemically synthesized
aaagtttttttaaaatgatgtt

SEQ ID NO: 1401035 - DNA, 22 bp, Artificial Sequence
  chemically synthesized
agtaattaaatgtgtaaacatc

SEQ ID NO: 1401036 - DNA, 22 bp, Artificial Sequence
  chemically synthesized
ttttaaaatgatgtttacacat

SEQ ID NO: 1401037 - DNA, 22 bp, Artificial Sequence
  chemically synthesized
tttaaaatgatgtttacacatt

SEQ ID NO: 1401038 - DNA, 22 bp, Artificial Sequence
  chemically synthesized
ttaaaatgatgtttacacattt

SEQ ID NO: 1401039 - DNA, 22 bp, Artificial Sequence
  chemically synthesized
taaaatgatgtttacacattta

SEQ ID NO: 1401040 - DNA, 22 bp, Artificial Sequence
  chemically synthesized
aaaatgatgtttacacatttaa

SEQ ID NO: 1401041 - DNA, 22 bp, Artificial Sequence
  chemically synthesized
aaatgatgtttacacatttaat

SEQ ID NO: 1401042 - DNA, 22 bp, Artificial Sequence
  chemically synthesized
acacatttaattactcagtgta

SEQ ID NO: 1401043 - DNA, 22 bp, Artificial Sequence
  chemically synthesized
cacatttaattactcagtgtat

SEQ ID NO: 1401044 - DNA, 22 bp, Artificial Sequence
  chemically synthesized
gaaaaaaaaaaaaaatacactg

SEQ ID NO: 1401045 - DNA, 22 bp, Artificial Sequence
  chemically synthesized
tctcgaaaaaaaaaaaaaatac

SEQ ID NO: 1401046 - DNA, 22 bp, Artificial Sequence
  chemically synthesized
aattactcagtgtatttttttt

SEQ ID NO: 1401047 - DNA, 22 bp, Artificial Sequence
  chemically synthesized
attactcagtgtattttttttt

SEQ ID NO: 1401048 - DNA, 22 bp, Artificial Sequence
  chemically synthesized
tgtctcgaaaaaaaaaaaaaat

SEQ ID NO: 1401049 - DNA, 22 bp, Artificial Sequence
  chemically synthesized
ctcagtgtattttttttttttt

SEQ ID NO: 1401050 - DNA, 22 bp, Artificial Sequence
  chemically synthesized
agtgtattttttttttttttcg

SEQ ID NO: 1401051 - DNA, 22 bp, Artificial Sequence
  chemically synthesized
tttttttttttcgagacagagt

SEQ ID NO: 1401052 - DNA, 22 bp, Artificial Sequence
  chemically synthesized
ttttttttttcgagacagagtc

SEQ ID NO: 1401053 - DNA, 22 bp, Artificial Sequence
  chemically synthesized
tttttttttcgagacagagtct

SEQ ID NO: 1401054 - DNA, 22 bp, Artificial Sequence
  chemically synthesized
ggtgacagagcaagactctgtc

SEQ ID NO: 1401055 - DNA, 22 bp, Artificial Sequence
  chemically synthesized
ttttttttcgagacagagtctt

SEQ ID NO: 1401056 - DNA, 22 bp, Artificial Sequence
  chemically synthesized
tttttttcgagacagagtcttg

SEQ ID NO: 1401057 - DNA, 22 bp, Artificial Sequence
  chemically synthesized
ttttttcgagacagagtcttgc

SEQ ID NO: 1401058 - DNA, 22 bp, Artificial Sequence
  chemically synthesized
tttttcgagacagagtcttgct

SEQ ID NO: 1401059 - DNA, 22 bp, Artificial Sequence
  chemically synthesized
ttttcgagacagagtcttgctc

SEQ ID NO: 1401060 - DNA, 22 bp, Artificial Sequence
  chemically synthesized
tttcgagacagagtcttgctct

SEQ ID NO: 1401061 - DNA, 22 bp, Artificial Sequence
  chemically synthesized
accctgggtgacagagcaagac

SEQ ID NO: 1401062 - DNA, 22 bp, Artificial Sequence
  chemically synthesized
ttcgagacagagtcttgctctg

SEQ ID NO: 1401063 - DNA, 22 bp, Artificial Sequence
  chemically synthesized
caccctgggtgacagagcaaga

SEQ ID NO: 1401064 - DNA, 22 bp, Artificial Sequence
  chemically synthesized
tcgagacagagtcttgctctgt

SEQ ID NO: 1401065 - DNA, 22 bp, Artificial Sequence
  chemically synthesized
cgagacagagtcttgctctgtc

SEQ ID NO: 1401066 - DNA, 22 bp, Artificial Sequence
  chemically synthesized
gagacagagtcttgctctgtca

SEQ ID NO: 1401067 - DNA, 22 bp, Artificial Sequence
  chemically synthesized
cacttcaccctgggtgacagag

SEQ ID NO: 1401068 - DNA, 22 bp, Artificial Sequence
  chemically synthesized
gctctgtcacccagggtgaagt

SEQ ID NO: 1401069 - DNA, 22 bp, Artificial Sequence
  chemically synthesized
ctctgtcacccagggtgaagtg

SEQ ID NO: 1401070 - DNA, 22 bp, Artificial Sequence
  chemically synthesized
tgtcacccagggtgaagtgcag

SEQ ID NO: 1401071 - DNA, 22 bp, Artificial Sequence
  chemically synthesized
tcacccagggtgaagtgcagtg

SEQ ID NO: 1401072 - DNA, 22 bp, Artificial Sequence
  chemically synthesized
cagtgagcggaaatggtgtcac

SEQ ID NO: 1401073 - DNA, 22 bp, Artificial Sequence
  chemically synthesized
ggaggtgggggttgcagtgagc

SEQ ID NO: 1401074 - DNA, 22 bp, Artificial Sequence
  chemically synthesized
gaacctgggaggtgggggttgc

SEQ ID NO: 1401075 - DNA, 22 bp, Artificial Sequence
  chemically synthesized
ccgctcactgcaacccccacct

SEQ ID NO: 1401076 - DNA, 22 bp, Artificial Sequence
  chemically synthesized
cgctcactgcaacccccacctc

SEQ ID NO: 1401077 - DNA, 22 bp, Artificial Sequence
  chemically synthesized
actgcaacccccacctcccagg

SEQ ID NO: 1401078 - DNA, 22 bp, Artificial Sequence
  chemically synthesized
gagaatcactcgaacctgggag

SEQ ID NO: 1401079 - DNA, 22 bp, Artificial Sequence
  chemically synthesized
caacccccacctcccaggttcg

SEQ ID NO: 1401080 - DNA, 22 bp, Artificial Sequence
  chemically synthesized
aggctggagaatcactcgaacc

SEQ ID NO: 1401081 - DNA, 22 bp, Artificial Sequence
  chemically synthesized
ccaggttcgagtgattctccag

SEQ ID NO: 1401082 - DNA, 22 bp, Artificial Sequence
  chemically synthesized
gggtggctgaggctggagaatc

SEQ ID NO: 1401083 - DNA, 22 bp, Artificial Sequence
  chemically synthesized
agggtggctgaggctggagaat

SEQ ID NO: 1401084 - DNA, 22 bp, Artificial Sequence
  chemically synthesized
tagggtggctgaggctggagaa

SEQ ID NO: 1401085 - DNA, 22 bp, Artificial Sequence
  chemically synthesized
gagtgattctccagcctcagcc

SEQ ID NO: 1401086 - DNA, 22 bp, Artificial Sequence
  chemically synthesized
tccagcctcagccaccctaaag

SEQ ID NO: 1401087 - DNA, 22 bp, Artificial Sequence
  chemically synthesized
cagcctcagccaccctaaagtg

SEQ ID NO: 1401088 - DNA, 22 bp, Artificial Sequence
  chemically synthesized
ggcatggtggcacactttaggg

SEQ ID NO: 1401089 - DNA, 22 bp, Artificial Sequence
  chemically synthesized
ctgggcatggtggcacacttta

SEQ ID NO: 1401090 - DNA, 22 bp, Artificial Sequence
  chemically synthesized
gctgggcatggtggcacacttt

SEQ ID NO: 1401091 - DNA, 22 bp, Artificial Sequence
  chemically synthesized
tgctgggcatggtggcacactt

SEQ ID NO: 1401092 - DNA, 22 bp, Artificial Sequence
  chemically synthesized
agccaccctaaagtgtgccacc

SEQ ID NO: 1401093 - DNA, 22 bp, Artificial Sequence
  chemically synthesized
aagtgtgccaccatgcccagca

SEQ ID NO: 1401094 - DNA, 22 bp, Artificial Sequence
  chemically synthesized
agaaatacaaacaaacaaaaaa

SEQ ID NO: 1401095 - DNA, 22 bp, Artificial Sequence
  chemically synthesized
ctaagaaatacaaacaaacaaa

SEQ ID NO: 1401096 - DNA, 22 bp, Artificial Sequence
  chemically synthesized
tactaagaaatacaaacaaaca

SEQ ID NO: 1401097 - DNA, 22 bp, Artificial Sequence
  chemically synthesized
tctctactaagaaatacaaaca

SEQ ID NO: 1401098 - DNA, 22 bp, Artificial Sequence
  chemically synthesized
tttttttgtttgtttgtatttc

SEQ ID NO: 1401099 - DNA, 22 bp, Artificial Sequence
  chemically synthesized
ttttttgtttgtttgtatttct

SEQ ID NO: 1401100 - DNA, 22 bp, Artificial Sequence
  chemically synthesized
tttttgtttgtttgtatttctt

SEQ ID NO: 1401101 - DNA, 22 bp, Artificial Sequence
  chemically synthesized
ttttgtttgtttgtatttctta

SEQ ID NO: 1401102 - DNA, 22 bp, Artificial Sequence
  chemically synthesized
tttgtttgtttgtatttcttag

SEQ ID NO: 1401103 - DNA, 22 bp, Artificial Sequence
  chemically synthesized
ttgtttgtttgtatttcttagt

SEQ ID NO: 1401104 - DNA, 22 bp, Artificial Sequence
  chemically synthesized
tgtttgtttgtatttcttagta

SEQ ID NO: 1401105 - DNA, 22 bp, Artificial Sequence
  chemically synthesized
gtttgtttgtatttcttagtag

SEQ ID NO: 1401106 - DNA, 22 bp, Artificial Sequence
  chemically synthesized
tttgtttgtatttcttagtaga

SEQ ID NO: 1401107 - DNA, 22 bp, Artificial Sequence
  chemically synthesized
gtttgtatttcttagtagagac

SEQ ID NO: 1401108 - DNA, 22 bp, Artificial Sequence
  chemically synthesized
tttgtatttcttagtagagaca

SEQ ID NO: 1401109 - DNA, 22 bp, Artificial Sequence
  chemically synthesized
gtatttcttagtagagacaggg

SEQ ID NO: 1401110 - DNA, 22 bp, Artificial Sequence
  chemically synthesized
tatttcttagtagagacagggt

SEQ ID NO: 1401111 - DNA, 22 bp, Artificial Sequence
  chemically synthesized
gccaacatggtgaaaccctgtc

SEQ ID NO: 1401112 - DNA, 22 bp, Artificial Sequence
  chemically synthesized
ggccaacatggtgaaaccctgt

SEQ ID NO: 1401113 - DNA, 22 bp, Artificial Sequence
  chemically synthesized
cttagtagagacagggtttcac

SEQ ID NO: 1401114 - DNA, 22 bp, Artificial Sequence
  chemically synthesized
ttagtagagacagggtttcacc

SEQ ID NO: 1401115 - DNA, 22 bp, Artificial Sequence
  chemically synthesized
agtagagacagggtttcaccat

SEQ ID NO: 1401116 - DNA, 22 bp, Artificial Sequence
  chemically synthesized
gtagagacagggtttcaccatg

SEQ ID NO: 1401117 - DNA, 22 bp, Artificial Sequence
  chemically synthesized
gagaccagcttggccaacatgg

SEQ ID NO: 1401118 - DNA, 22 bp, Artificial Sequence
  chemically synthesized
caccatgttggccaagctggtc

SEQ ID NO: 1401119 - DNA, 22 bp, Artificial Sequence
  chemically synthesized
accatgttggccaagctggtct

SEQ ID NO: 1401120 - DNA, 22 bp, Artificial Sequence
  chemically synthesized
aggtcaggagttcgagaccagc

SEQ ID NO: 1401121 - DNA, 22 bp, Artificial Sequence
  chemically synthesized
gaggtcaggagttcgagaccag

SEQ ID NO: 1401122 - DNA, 22 bp, Artificial Sequence
  chemically synthesized
gccaagctggtctcgaactcct

SEQ ID NO: 1401123 - DNA, 22 bp, Artificial Sequence
  chemically synthesized
gtctcgaactcctgacctcaaa

SEQ ID NO: 1401124 - DNA, 22 bp, Artificial Sequence
  chemically synthesized
aggcaggtggatcatttgaggt

SEQ ID NO: 1401125 - DNA, 22 bp, Artificial Sequence
  chemically synthesized
gaactcctgacctcaaatgatc

SEQ ID NO: 1401126 - DNA, 22 bp, Artificial Sequence
  chemically synthesized
ggaggctgaggcaggtggatca

SEQ ID NO: 1401127 - DNA, 22 bp, Artificial Sequence
  chemically synthesized
ctgacctcaaatgatccacctg

SEQ ID NO: 1401128 - DNA, 22 bp, Artificial Sequence
  chemically synthesized
gggaggctgaggcaggtggatc

SEQ ID NO: 1401129 - DNA, 22 bp, Artificial Sequence
  chemically synthesized
tgggaggctgaggcaggtggat

SEQ ID NO: 1401130 - DNA, 22 bp, Artificial Sequence
  chemically synthesized
acctcaaatgatccacctgcct

SEQ ID NO: 1401131 - DNA, 22 bp, Artificial Sequence
  chemically synthesized
aaatgatccacctgcctcagcc

SEQ ID NO: 1401132 - DNA, 22 bp, Artificial Sequence
  chemically synthesized
taaccccagcactttgggaggc

SEQ ID NO: 1401133 - DNA, 22 bp, Artificial Sequence
  chemically synthesized
cctcagcctcccaaagtgctgg

SEQ ID NO: 1401134 - DNA, 22 bp, Artificial Sequence
  chemically synthesized
atgcctgtaaccccagcacttt

SEQ ID NO: 1401135 - DNA, 22 bp, Artificial Sequence
  chemically synthesized
agcctcccaaagtgctggggtt

SEQ ID NO: 1401136 - DNA, 22 bp, Artificial Sequence
  chemically synthesized
ccaaagtgctggggttacaggc

SEQ ID NO: 1401137 - DNA, 22 bp, Artificial Sequence
  chemically synthesized
gggttacaggcatgagtcacct

SEQ ID NO: 1401138 - DNA, 22 bp, Artificial Sequence
  chemically synthesized
aggaagtaggccaggcaaggtg

SEQ ID NO: 1401139 - DNA, 22 bp, Artificial Sequence
  chemically synthesized
caggcatgagtcaccttgcctg

SEQ ID NO: 1401140 - DNA, 22 bp, Artificial Sequence
  chemically synthesized
agtaagactgaggaagtaggcc

SEQ ID NO: 1401141 - DNA, 22 bp, Artificial Sequence
  chemically synthesized
gcctggcctacttcctcagtct

SEQ ID NO: 1401142 - DNA, 22 bp, Artificial Sequence
  chemically synthesized
cctggcctacttcctcagtctt

SEQ ID NO: 1401143 - DNA, 22 bp, Artificial Sequence
  chemically synthesized
gcctacttcctcagtcttactg

SEQ ID NO: 1401144 - DNA, 22 bp, Artificial Sequence
  chemically synthesized
aggggaaaatactcagtaagac

SEQ ID NO: 1401145 - DNA, 22 bp, Artificial Sequence
  chemically synthesized
tcaggggaaaatactcagtaag

SEQ ID NO: 1401146 - DNA, 22 bp, Artificial Sequence
  chemically synthesized
cttcctcagtcttactgagtat

SEQ ID NO: 1401147 - DNA, 22 bp, Artificial Sequence
  chemically synthesized
attctcaggggaaaatactcag

SEQ ID NO: 1401148 - DNA, 22 bp, Artificial Sequence
  chemically synthesized
cctcagtcttactgagtatttt

SEQ ID NO: 1401149 - DNA, 22 bp, Artificial Sequence
  chemically synthesized
ctcagtcttactgagtattttc

SEQ ID NO: 1401150 - DNA, 22 bp, Artificial Sequence
  chemically synthesized
tctaattctcaggggaaaatac

SEQ ID NO: 1401151 - DNA, 22 bp, Artificial Sequence
  chemically synthesized
agtcttactgagtattttcccc

SEQ ID NO: 1401152 - DNA, 22 bp, Artificial Sequence
  chemically synthesized
actgagtattttcccctgagaa

SEQ ID NO: 1401153 - DNA, 22 bp, Artificial Sequence
  chemically synthesized
ctgagtattttcccctgagaat

SEQ ID NO: 1401154 - DNA, 22 bp, Artificial Sequence
  chemically synthesized
agtattttcccctgagaattag

SEQ ID NO: 1401155 - DNA, 22 bp, Artificial Sequence
  chemically synthesized
tcccctgagaattagataattg

SEQ ID NO: 1401156 - DNA, 22 bp, Artificial Sequence
  chemically synthesized
cccctgagaattagataattgg

SEQ ID NO: 1401157 - DNA, 22 bp, Artificial Sequence
  chemically synthesized
ccctgagaattagataattggc

SEQ ID NO: 1401158 - DNA, 22 bp, Artificial Sequence
  chemically synthesized
gaatgtggtaaggccaattatc

SEQ ID NO: 1401159 - DNA, 22 bp, Artificial Sequence
  chemically synthesized
ggaatgtggtaaggccaattat

SEQ ID NO: 1401160 - DNA, 22 bp, Artificial Sequence
  chemically synthesized
tggaatgtggtaaggccaatta

SEQ ID NO: 1401161 - DNA, 22 bp, Artificial Sequence
  chemically synthesized
agaattagataattggccttac

SEQ ID NO: 1401162 - DNA, 22 bp, Artificial Sequence
  chemically synthesized
gattttggaatgtggtaaggcc

SEQ ID NO: 1401163 - DNA, 22 bp, Artificial Sequence
  chemically synthesized
gataattggccttaccacattc

SEQ ID NO: 1401164 - DNA, 22 bp, Artificial Sequence
  chemically synthesized
gccttaccacattccaaaatcc

SEQ ID NO: 1401165 - DNA, 22 bp, Artificial Sequence
  chemically synthesized
agaagagaatcactggattttg

SEQ ID NO: 1401166 - DNA, 22 bp, Artificial Sequence
  chemically synthesized
accacattccaaaatccagtga

SEQ ID NO: 1401167 - DNA, 22 bp, Artificial Sequence
  chemically synthesized
ccacattccaaaatccagtgat

SEQ ID NO: 1401168 - DNA, 22 bp, Artificial Sequence
  chemically synthesized
caaaatccagtgattctcttct

SEQ ID NO: 1401169 - DNA, 22 bp, Artificial Sequence
  chemically synthesized
tgtgggatataacatgagcatg

SEQ ID NO: 1401170 - DNA, 22 bp, Artificial Sequence
  chemically synthesized
tcttcttaacatgctcatgtta

SEQ ID NO: 1401171 - DNA, 22 bp, Artificial Sequence
  chemically synthesized
ttgtgtgggatataacatgagc

SEQ ID NO: 1401172 - DNA, 22 bp, Artificial Sequence
  chemically synthesized
ttcttaacatgctcatgttata

SEQ ID NO: 1401173 - DNA, 22 bp, Artificial Sequence
  chemically synthesized
cttaacatgctcatgttatatc

SEQ ID NO: 1401174 - DNA, 22 bp, Artificial Sequence
  chemically synthesized
ttaacatgctcatgttatatcc

SEQ ID NO: 1401175 - DNA, 22 bp, Artificial Sequence
  chemically synthesized
gtactgttgtgtgggatataac

SEQ ID NO: 1401176 - DNA, 22 bp, Artificial Sequence
  chemically synthesized
aacatgctcatgttatatccca

SEQ ID NO: 1401177 - DNA, 22 bp, Artificial Sequence
  chemically synthesized
acatgctcatgttatatcccac

SEQ ID NO: 1401178 - DNA, 22 bp, Artificial Sequence
  chemically synthesized
atgttatatcccacacaacagt

SEQ ID NO: 1401179 - DNA, 22 bp, Artificial Sequence
  chemically synthesized
gaataatgtattagtactgttg

SEQ ID NO: 1401180 - DNA, 22 bp, Artificial Sequence
  chemically synthesized
tatcccacacaacagtactaat

SEQ ID NO: 1401181 - DNA, 22 bp, Artificial Sequence
  chemically synthesized
caagcaaaattagaataatgta

SEQ ID NO: 1401182 - DNA, 22 bp, Artificial Sequence
  chemically synthesized
atacattattctaattttgctt

SEQ ID NO: 1401183 - DNA, 22 bp, Artificial Sequence
  chemically synthesized
tagcaacattgcaagcaaaatt

SEQ ID NO: 1401184 - DNA, 22 bp, Artificial Sequence
  chemically synthesized
atactatagcaacattgcaagc

SEQ ID NO: 1401185 - DNA, 22 bp, Artificial Sequence
  chemically synthesized
ttctaattttgcttgcaatgtt

SEQ ID NO: 1401186 - DNA, 22 bp, Artificial Sequence
  chemically synthesized
taattttgcttgcaatgttgct

SEQ ID NO: 1401187 - DNA, 22 bp, Artificial Sequence
  chemically synthesized
attttgcttgcaatgttgctat

SEQ ID NO: 1401188 - DNA, 22 bp, Artificial Sequence
  chemically synthesized
tgcttgcaatgttgctatagta

SEQ ID NO: 1401189 - DNA, 22 bp, Artificial Sequence
  chemically synthesized
gcttgcaatgttgctatagtat

SEQ ID NO: 1401190 - DNA, 22 bp, Artificial Sequence
  chemically synthesized
cttgcaatgttgctatagtatg

SEQ ID NO: 1401191 - DNA, 22 bp, Artificial Sequence
  chemically synthesized
gcaatgttgctatagtatgaat

SEQ ID NO: 1401192 - DNA, 22 bp, Artificial Sequence
  chemically synthesized
caatgttgctatagtatgaata

SEQ ID NO: 1401193 - DNA, 22 bp, Artificial Sequence
  chemically synthesized
gaggaacacaaatattcatact

SEQ ID NO: 1401194 - DNA, 22 bp, Artificial Sequence
  chemically synthesized
ggaggaacacaaatattcatac

SEQ ID NO: 1401195 - DNA, 22 bp, Artificial Sequence
  chemically synthesized
tggaggaacacaaatattcata

SEQ ID NO: 1401196 - DNA, 22 bp, Artificial Sequence
  chemically synthesized
aattttggaggaacacaaatat

SEQ ID NO: 1401197 - DNA, 22 bp, Artificial Sequence
  chemically synthesized
ctatagtatgaatatttgtgtt

SEQ ID NO: 1401198 - DNA, 22 bp, Artificial Sequence
  chemically synthesized
aaattttggaggaacacaaata

SEQ ID NO: 1401199 - DNA, 22 bp, Artificial Sequence
  chemically synthesized
tagtatgaatatttgtgttcct

SEQ ID NO: 1401200 - DNA, 22 bp, Artificial Sequence
  chemically synthesized
aacatttaaattttggaggaac

SEQ ID NO: 1401201 - DNA, 22 bp, Artificial Sequence
  chemically synthesized
caacatttaaattttggaggaa

SEQ ID NO: 1401202 - DNA, 22 bp, Artificial Sequence
  chemically synthesized
tcaacatttaaattttggagga

SEQ ID NO: 1401203 - DNA, 22 bp, Artificial Sequence
  chemically synthesized
gctttcaacatttaaattttgg

SEQ ID NO: 1401204 - DNA, 22 bp, Artificial Sequence
  chemically synthesized
gtgttcctccaaaatttaaatg

SEQ ID NO: 1401205 - DNA, 22 bp, Artificial Sequence
  chemically synthesized
tgttcctccaaaatttaaatgt

SEQ ID NO: 1401206 - DNA, 22 bp, Artificial Sequence
  chemically synthesized
gggattagctttcaacatttaa

SEQ ID NO: 1401207 - DNA, 22 bp, Artificial Sequence
  chemically synthesized
ggggattagctttcaacattta

SEQ ID NO: 1401208 - DNA, 22 bp, Artificial Sequence
  chemically synthesized
ctccaaaatttaaatgttgaaa

SEQ ID NO: 1401209 - DNA, 22 bp, Artificial Sequence
  chemically synthesized
ttggggattagctttcaacatt

SEQ ID NO: 1401210 - DNA, 22 bp, Artificial Sequence
  chemically synthesized
caaaatttaaatgttgaaagct

SEQ ID NO: 1401211 - DNA, 22 bp, Artificial Sequence
  chemically synthesized
aaatgttgaaagctaatcccca

SEQ ID NO: 1401212 - DNA, 22 bp, Artificial Sequence
  chemically synthesized
ataccaacctcttggggattag

SEQ ID NO: 1401213 - DNA, 22 bp, Artificial Sequence
  chemically synthesized
aatgttgaaagctaatccccaa

SEQ ID NO: 1401214 - DNA, 22 bp, Artificial Sequence
  chemically synthesized
aaagctaatccccaagaggttg

SEQ ID NO: 1401215 - DNA, 22 bp, Artificial Sequence
  chemically synthesized
accccctaataccaacctcttg

SEQ ID NO: 1401216 - DNA, 22 bp, Artificial Sequence
  chemically synthesized
atccccaagaggttggtattag

SEQ ID NO: 1401217 - DNA, 22 bp, Artificial Sequence
  chemically synthesized
aagacctcaccccctaatacca

SEQ ID NO: 1401218 - DNA, 22 bp, Artificial Sequence
  chemically synthesized
atcacaacctaaagacctcacc

SEQ ID NO: 1401219 - DNA, 22 bp, Artificial Sequence
  chemically synthesized
gtattagggggtgaggtcttta

SEQ ID NO: 1401220 - DNA, 22 bp, Artificial Sequence
  chemically synthesized
ataacctaatcacaacctaaag

SEQ ID NO: 1401221 - DNA, 22 bp, Artificial Sequence
  chemically synthesized
gggggtgaggtctttaggttgt

SEQ ID NO: 1401222 - DNA, 22 bp, Artificial Sequence
  chemically synthesized
tactcataacctaatcacaacc

SEQ ID NO: 1401223 - DNA, 22 bp, Artificial Sequence
  chemically synthesized
tgtactcataacctaatcacaa

SEQ ID NO: 1401224 - DNA, 22 bp, Artificial Sequence
  chemically synthesized
taggttgtgattaggttatgag

SEQ ID NO: 1401225 - DNA, 22 bp, Artificial Sequence
  chemically synthesized
aggttgtgattaggttatgagt

SEQ ID NO: 1401226 - DNA, 22 bp, Artificial Sequence
  chemically synthesized
ggttgtgattaggttatgagta

SEQ ID NO: 1401227 - DNA, 22 bp, Artificial Sequence
  chemically synthesized
tgattaggttatgagtacagag

SEQ ID NO: 1401228 - DNA, 22 bp, Artificial Sequence
  chemically synthesized
atcccaaacaagaaggctctgt

SEQ ID NO: 1401229 - DNA, 22 bp, Artificial Sequence
  chemically synthesized
ggttatgagtacagagccttct

SEQ ID NO: 1401230 - DNA, 22 bp, Artificial Sequence
  chemically synthesized
tgagtacagagccttcttgttt

SEQ ID NO: 1401231 - DNA, 22 bp, Artificial Sequence
  chemically synthesized
taagggtactaatcccaaacaa

SEQ ID NO: 1401232 - DNA, 22 bp, Artificial Sequence
  chemically synthesized
ataagggtactaatcccaaaca

SEQ ID NO: 1401233 - DNA, 22 bp, Artificial Sequence
  chemically synthesized
tataagggtactaatcccaaac

SEQ ID NO: 1401234 - DNA, 22 bp, Artificial Sequence
  chemically synthesized
ttataagggtactaatcccaaa

SEQ ID NO: 1401235 - DNA, 22 bp, Artificial Sequence
  chemically synthesized
ttttataagggtactaatccca

SEQ ID NO: 1401236 - DNA, 22 bp, Artificial Sequence
  chemically synthesized
cttgtttgggattagtaccctt

SEQ ID NO: 1401237 - DNA, 22 bp, Artificial Sequence
  chemically synthesized
ttgtttgggattagtaccctta

SEQ ID NO: 1401238 - DNA, 22 bp, Artificial Sequence
  chemically synthesized
gggtctcttttataagggtact

SEQ ID NO: 1401239 - DNA, 22 bp, Artificial Sequence
  chemically synthesized
gtttgggattagtacccttata

SEQ ID NO: 1401240 - DNA, 22 bp, Artificial Sequence
  chemically synthesized
tagggtctcttttataagggta

SEQ ID NO: 1401241 - DNA, 22 bp, Artificial Sequence
  chemically synthesized
tttgggattagtacccttataa

SEQ ID NO: 1401242 - DNA, 22 bp, Artificial Sequence
  chemically synthesized
tctagggtctcttttataaggg

SEQ ID NO: 1401243 - DNA, 22 bp, Artificial Sequence
  chemically synthesized
gggattagtacccttataaaag

SEQ ID NO: 1401244 - DNA, 22 bp, Artificial Sequence
  chemically synthesized
ggattagtacccttataaaaga

SEQ ID NO: 1401245 - DNA, 22 bp, Artificial Sequence
  chemically synthesized
gctctctagggtctcttttata

SEQ ID NO: 1401246 - DNA, 22 bp, Artificial Sequence
  chemically synthesized
gtacccttataaaagagaccct

SEQ ID NO: 1401247 - DNA, 22 bp, Artificial Sequence
  chemically synthesized
ataaaagagaccctagagagcc

SEQ ID NO: 1401248 - DNA, 22 bp, Artificial Sequence
  chemically synthesized
taaaagagaccctagagagcca

SEQ ID NO: 1401249 - DNA, 22 bp, Artificial Sequence
  chemically synthesized
tatgatgaagaggcgagctggc

SEQ ID NO: 1401250 - DNA, 22 bp, Artificial Sequence
  chemically synthesized
atatgatgaagaggcgagctgg

SEQ ID NO: 1401251 - DNA, 22 bp, Artificial Sequence
  chemically synthesized
gagagccagctcgcctcttcat

SEQ ID NO: 1401252 - DNA, 22 bp, Artificial Sequence
  chemically synthesized
tgtccttatatgatgaagaggc

SEQ ID NO: 1401253 - DNA, 22 bp, Artificial Sequence
  chemically synthesized
ctgtgtccttatatgatgaaga

SEQ ID NO: 1401254 - DNA, 22 bp, Artificial Sequence
  chemically synthesized
ttgctgtgtccttatatgatga

SEQ ID NO: 1401255 - DNA, 22 bp, Artificial Sequence
  chemically synthesized
gttgctgtgtccttatatgatg

SEQ ID NO: 1401256 - DNA, 22 bp, Artificial Sequence
  chemically synthesized
gcctcttcatcatataaggaca

SEQ ID NO: 1401257 - DNA, 22 bp, Artificial Sequence
  chemically synthesized
ttcatcatataaggacacagca

SEQ ID NO: 1401258 - DNA, 22 bp, Artificial Sequence
  chemically synthesized
gatggtaccttgttgctgtgtc

SEQ ID NO: 1401259 - DNA, 22 bp, Artificial Sequence
  chemically synthesized
catcatataaggacacagcaac

SEQ ID NO: 1401260 - DNA, 22 bp, Artificial Sequence
  chemically synthesized
atcatataaggacacagcaaca

SEQ ID NO: 1401261 - DNA, 22 bp, Artificial Sequence
  chemically synthesized
ctagatggtaccttgttgctgt

SEQ ID NO: 1401262 - DNA, 22 bp, Artificial Sequence
  chemically synthesized
gctactagatggtaccttgttg

SEQ ID NO: 1401263 - DNA, 22 bp, Artificial Sequence
  chemically synthesized
ctagctactagatggtaccttg

SEQ ID NO: 1401264 - DNA, 22 bp, Artificial Sequence
  chemically synthesized
cctagctactagatggtacctt

SEQ ID NO: 1401265 - DNA, 22 bp, Artificial Sequence
  chemically synthesized
atgacagaccgtttcctagcta

SEQ ID NO: 1401266 - DNA, 22 bp, Artificial Sequence
  chemically synthesized
tgcctgatgacagaccgtttcc

SEQ ID NO: 1401267 - DNA, 22 bp, Artificial Sequence
  chemically synthesized
tgtgcctgatgacagaccgttt

SEQ ID NO: 1401268 - DNA, 22 bp, Artificial Sequence
  chemically synthesized
gtagctaggaaacggtctgtca

SEQ ID NO: 1401269 - DNA, 22 bp, Artificial Sequence
  chemically synthesized
ggaaacggtctgtcatcaggca

SEQ ID NO: 1401270 - DNA, 22 bp, Artificial Sequence
  chemically synthesized
tcatcaggcacagagtgtgcct

SEQ ID NO: 1401271 - DNA, 22 bp, Artificial Sequence
  chemically synthesized
ggaagtccaagatcaagatgaa

SEQ ID NO: 1401272 - DNA, 22 bp, Artificial Sequence
  chemically synthesized
gaggctgggaagtccaagatca

SEQ ID NO: 1401273 - DNA, 22 bp, Artificial Sequence
  chemically synthesized
tggaggctgggaagtccaagat

SEQ ID NO: 1401274 - DNA, 22 bp, Artificial Sequence
  chemically synthesized
catcttgatcttggacttccca

SEQ ID NO: 1401275 - DNA, 22 bp, Artificial Sequence
  chemically synthesized
atcttgatcttggacttcccag

SEQ ID NO: 1401276 - DNA, 22 bp, Artificial Sequence
  chemically synthesized
aaagttctggaggctgggaagt

SEQ ID NO: 1401277 - DNA, 22 bp, Artificial Sequence
  chemically synthesized
ctcaaagttctggaggctggga

SEQ ID NO: 1401278 - DNA, 22 bp, Artificial Sequence
  chemically synthesized
gatcttggacttcccagcctcc

SEQ ID NO: 1401279 - DNA, 22 bp, Artificial Sequence
  chemically synthesized
atcttggacttcccagcctcca

SEQ ID NO: 1401280 - DNA, 22 bp, Artificial Sequence
  chemically synthesized
attgctcaaagttctggaggct

SEQ ID NO: 1401281 - DNA, 22 bp, Artificial Sequence
  chemically synthesized
ggacttcccagcctccagaact

SEQ ID NO: 1401282 - DNA, 22 bp, Artificial Sequence
  chemically synthesized
gacttcccagcctccagaactt

SEQ ID NO: 1401283 - DNA, 22 bp, Artificial Sequence
  chemically synthesized
cccagcctccagaactttgagc

SEQ ID NO: 1401284 - DNA, 22 bp, Artificial Sequence
  chemically synthesized
ccagcctccagaactttgagca

SEQ ID NO: 1401285 - DNA, 22 bp, Artificial Sequence
  chemically synthesized
cagaactttgagcaatgaatct

SEQ ID NO: 1401286 - DNA, 22 bp, Artificial Sequence
  chemically synthesized
ggtggcgtagaaacaacagaga

SEQ ID NO: 1401287 - DNA, 22 bp, Artificial Sequence
  chemically synthesized
tgagcaatgaatctctgttgtt

SEQ ID NO: 1401288 - DNA, 22 bp, Artificial Sequence
  chemically synthesized
gagcaatgaatctctgttgttt

SEQ ID NO: 1401289 - DNA, 22 bp, Artificial Sequence
  chemically synthesized
agcaatgaatctctgttgtttc

SEQ ID NO: 1401290 - DNA, 22 bp, Artificial Sequence
  chemically synthesized
tgttgtttctacgccacccagt

SEQ ID NO: 1401291 - DNA, 22 bp, Artificial Sequence
  chemically synthesized
aaaaaataataaactgggtggc

SEQ ID NO: 1401292 - DNA, 22 bp, Artificial Sequence
  chemically synthesized
ttgtttctacgccacccagttt

SEQ ID NO: 1401293 - DNA, 22 bp, Artificial Sequence
  chemically synthesized
tttctacgccacccagtttatt

SEQ ID NO: 1401294 - DNA, 22 bp, Artificial Sequence
  chemically synthesized
ctacgccacccagtttattatt

SEQ ID NO: 1401295 - DNA, 22 bp, Artificial Sequence
  chemically synthesized
tacgccacccagtttattattt

SEQ ID NO: 1401296 - DNA, 22 bp, Artificial Sequence
  chemically synthesized
cgccacccagtttattattttt

SEQ ID NO: 1401297 - DNA, 22 bp, Artificial Sequence
  chemically synthesized
ggtggcgtaaactaaaaaaata

SEQ ID NO: 1401298 - DNA, 22 bp, Artificial Sequence
  chemically synthesized
attatttttttagtttacgcca

SEQ ID NO: 1401299 - DNA, 22 bp, Artificial Sequence
  chemically synthesized
ttatttttttagtttacgccac

SEQ ID NO: 1401300 - DNA, 22 bp, Artificial Sequence
  chemically synthesized
tttttttagtttacgccaccca

SEQ ID NO: 1401301 - DNA, 22 bp, Artificial Sequence
  chemically synthesized
ttttagtttacgccacccagtt

SEQ ID NO: 1401302 - DNA, 22 bp, Artificial Sequence
  chemically synthesized
tttagtttacgccacccagttt

SEQ ID NO: 1401303 - DNA, 22 bp, Artificial Sequence
  chemically synthesized
ttagtttacgccacccagttta

SEQ ID NO: 1401304 - DNA, 22 bp, Artificial Sequence
  chemically synthesized
tagtttacgccacccagtttat

SEQ ID NO: 1401305 - DNA, 22 bp, Artificial Sequence
  chemically synthesized
agtttacgccacccagtttatt

SEQ ID NO: 1401306 - DNA, 22 bp, Artificial Sequence
  chemically synthesized
gtttacgccacccagtttatta

SEQ ID NO: 1401307 - DNA, 22 bp, Artificial Sequence
  chemically synthesized
taaaaaaaaataaataataaac

SEQ ID NO: 1401308 - DNA, 22 bp, Artificial Sequence
  chemically synthesized
acgccacccagtttattattta

SEQ ID NO: 1401309 - DNA, 22 bp, Artificial Sequence
  chemically synthesized
tataaaaaaaaataaataataa

SEQ ID NO: 1401310 - DNA, 22 bp, Artificial Sequence
  chemically synthesized
cgccacccagtttattatttat

SEQ ID NO: 1401311 - DNA, 22 bp, Artificial Sequence
  chemically synthesized
ctataaaaaaaaataaataata

SEQ ID NO: 1401312 - DNA, 22 bp, Artificial Sequence
  chemically synthesized
ggcttctataaaaaaaaataaa

SEQ ID NO: 1401313 - DNA, 22 bp, Artificial Sequence
  chemically synthesized
gggcttctataaaaaaaaataa

SEQ ID NO: 1401314 - DNA, 22 bp, Artificial Sequence
  chemically synthesized
attatttatttttttttataga

SEQ ID NO: 1401315 - DNA, 22 bp, Artificial Sequence
  chemically synthesized
ttatttatttttttttatagaa

SEQ ID NO: 1401316 - DNA, 22 bp, Artificial Sequence
  chemically synthesized
atccatttgggcttctataaaa

SEQ ID NO: 1401317 - DNA, 22 bp, Artificial Sequence
  chemically synthesized
catccatttgggcttctataaa

SEQ ID NO: 1401318 - DNA, 22 bp, Artificial Sequence
  chemically synthesized
tttatttttttttatagaagcc

SEQ ID NO: 1401319 - DNA, 22 bp, Artificial Sequence
  chemically synthesized
ttcatccatttgggcttctata

SEQ ID NO: 1401320 - DNA, 22 bp, Artificial Sequence
  chemically synthesized
atttttttttatagaagcccaa

SEQ ID NO: 1401321 - DNA, 22 bp, Artificial Sequence
  chemically synthesized
tttttttttatagaagcccaaa

SEQ ID NO: 1401322 - DNA, 22 bp, Artificial Sequence
  chemically synthesized
tcattcttcatccatttgggct

SEQ ID NO: 1401323 - DNA, 22 bp, Artificial Sequence
  chemically synthesized
ttttttatagaagcccaaatgg

SEQ ID NO: 1401324 - DNA, 22 bp, Artificial Sequence
  chemically synthesized
tttttatagaagcccaaatgga

SEQ ID NO: 1401325 - DNA, 22 bp, Artificial Sequence
  chemically synthesized
ttttatagaagcccaaatggat

SEQ ID NO: 1401326 - DNA, 22 bp, Artificial Sequence
  chemically synthesized
tttatagaagcccaaatggatg

SEQ ID NO: 1401327 - DNA, 22 bp, Artificial Sequence
  chemically synthesized
ttatagaagcccaaatggatga

SEQ ID NO: 1401328 - DNA, 22 bp, Artificial Sequence
  chemically synthesized
tatagaagcccaaatggatgaa

SEQ ID NO: 1401329 - DNA, 22 bp, Artificial Sequence
  chemically synthesized
atagaagcccaaatggatgaag

SEQ ID NO: 1401330 - DNA, 22 bp, Artificial Sequence
  chemically synthesized
tagaagcccaaatggatgaaga

SEQ ID NO: 1401331 - DNA, 22 bp, Artificial Sequence
  chemically synthesized
tgaaataactatcattcttcat

SEQ ID NO: 1401332 - DNA, 22 bp, Artificial Sequence
  chemically synthesized
actatgaaataactatcattct

SEQ ID NO: 1401333 - DNA, 22 bp, Artificial Sequence
  chemically synthesized
cactatgaaataactatcattc

SEQ ID NO: 1401334 - DNA, 22 bp, Artificial Sequence
  chemically synthesized
ttcactatgaaataactatcat

SEQ ID NO: 1401335 - DNA, 22 bp, Artificial Sequence
  chemically synthesized
tattcttcactatgaaataact

SEQ ID NO: 1401336 - DNA, 22 bp, Artificial Sequence
  chemically synthesized
atattcttcactatgaaataac

SEQ ID NO: 1401337 - DNA, 22 bp, Artificial Sequence
  chemically synthesized
tatattcttcactatgaaataa

SEQ ID NO: 1401338 - DNA, 22 bp, Artificial Sequence
  chemically synthesized
ttatattcttcactatgaaata

SEQ ID NO: 1401339 - DNA, 22 bp, Artificial Sequence
  chemically synthesized
tttttatattcttcactatgaa

SEQ ID NO: 1401340 - DNA, 22 bp, Artificial Sequence
  chemically synthesized
attatttttatattcttcacta

SEQ ID NO: 1401341 - DNA, 22 bp, Artificial Sequence
  chemically synthesized
tttcatagtgaagaatataaaa

SEQ ID NO: 1401342 - DNA, 22 bp, Artificial Sequence
  chemically synthesized
catagtgaagaatataaaaata

SEQ ID NO: 1401343 - DNA, 22 bp, Artificial Sequence
  chemically synthesized
atagtgaagaatataaaaataa

SEQ ID NO: 1401344 - DNA, 22 bp, Artificial Sequence
  chemically synthesized
tggatgtagtgatgctgattat

SEQ ID NO: 1401345 - DNA, 22 bp, Artificial Sequence
  chemically synthesized
attatggatgtagtgatgctga

SEQ ID NO: 1401346 - DNA, 22 bp, Artificial Sequence
  chemically synthesized
tgattatggatgtagtgatgct

SEQ ID NO: 1401347 - DNA, 22 bp, Artificial Sequence
  chemically synthesized
tctgattatggatgtagtgatg

SEQ ID NO: 1401348 - DNA, 22 bp, Artificial Sequence
  chemically synthesized
ctctgattatggatgtagtgat

SEQ ID NO: 1401349 - DNA, 22 bp, Artificial Sequence
  chemically synthesized
ccttctctgattatggatgtag

SEQ ID NO: 1401350 - DNA, 22 bp, Artificial Sequence
  chemically synthesized
tcccacccctcccttctctgat

SEQ ID NO: 1401351 - DNA, 22 bp, Artificial Sequence
  chemically synthesized
catccataatcagagaagggag

SEQ ID NO: 1401352 - DNA, 22 bp, Artificial Sequence
  chemically synthesized
attatcccacccctcccttctc

SEQ ID NO: 1401353 - DNA, 22 bp, Artificial Sequence
  chemically synthesized
ttcattatcccacccctccctt

SEQ ID NO: 1401354 - DNA, 22 bp, Artificial Sequence
  chemically synthesized
tgttcattatcccacccctccc

SEQ ID NO: 1401355 - DNA, 22 bp, Artificial Sequence
  chemically synthesized
tgactctgttcattatcccacc

SEQ ID NO: 1401356 - DNA, 22 bp, Artificial Sequence
  chemically synthesized
atgactctgttcattatcccac

SEQ ID NO: 1401357 - DNA, 22 bp, Artificial Sequence
  chemically synthesized
tacttatgactctgttcattat

SEQ ID NO: 1401358 - DNA, 22 bp, Artificial Sequence
  chemically synthesized
aatacattatacttatgactct

SEQ ID NO: 1401359 - DNA, 22 bp, Artificial Sequence
  chemically synthesized
taaatacattatacttatgact

SEQ ID NO: 1401360 - DNA, 22 bp, Artificial Sequence
  chemically synthesized
ctaaatacattatacttatgac

SEQ ID NO: 1401361 - DNA, 22 bp, Artificial Sequence
  chemically synthesized
atcccagatttctaaatacatt

SEQ ID NO: 1401362 - DNA, 22 bp, Artificial Sequence
  chemically synthesized
catcccagatttctaaatacat

SEQ ID NO: 1401363 - DNA, 22 bp, Artificial Sequence
  chemically synthesized
tgggatttcatcccagatttct

SEQ ID NO: 1401364 - DNA, 22 bp, Artificial Sequence
  chemically synthesized
atgggatttcatcccagatttc

SEQ ID NO: 1401365 - DNA, 22 bp, Artificial Sequence
  chemically synthesized
agtttatgggatttcatcccag

SEQ ID NO: 1401366 - DNA, 22 bp, Artificial Sequence
  chemically synthesized
aattcagtttatgggatttcat

SEQ ID NO: 1401367 - DNA, 22 bp, Artificial Sequence
  chemically synthesized
agaaatctgggatgaaatccca

SEQ ID NO: 1401368 - DNA, 22 bp, Artificial Sequence
  chemically synthesized
gaaatctgggatgaaatcccat

SEQ ID NO: 1401369 - DNA, 22 bp, Artificial Sequence
  chemically synthesized
aactcaattcagtttatgggat

SEQ ID NO: 1401370 - DNA, 22 bp, Artificial Sequence
  chemically synthesized
ggatgaaatcccataaactgaa

SEQ ID NO: 1401371 - DNA, 22 bp, Artificial Sequence
  chemically synthesized
atcatgggggaggagggcactc

SEQ ID NO: 1401372 - DNA, 22 bp, Artificial Sequence
  chemically synthesized
aattgagttgagtgccctcctc

SEQ ID NO: 1401373 - DNA, 22 bp, Artificial Sequence
  chemically synthesized
agttgagtgccctcctccccca

SEQ ID NO: 1401374 - DNA, 22 bp, Artificial Sequence
  chemically synthesized
atacacactcatcatgggggag

SEQ ID NO: 1401375 - DNA, 22 bp, Artificial Sequence
  chemically synthesized
catacacactcatcatggggga

SEQ ID NO: 1401376 - DNA, 22 bp, Artificial Sequence
  chemically synthesized
tcatacacactcatcatggggg

SEQ ID NO: 1401377 - DNA, 22 bp, Artificial Sequence
  chemically synthesized
agtgccctcctcccccatgatg

SEQ ID NO: 1401378 - DNA, 22 bp, Artificial Sequence
  chemically synthesized
gtgcattttcatacacactcat

SEQ ID NO: 1401379 - DNA, 22 bp, Artificial Sequence
  chemically synthesized
ctcccccatgatgagtgtgtat

SEQ ID NO: 1401380 - DNA, 22 bp, Artificial Sequence
  chemically synthesized
tagtgcattttcatacacactc

SEQ ID NO: 1401381 - DNA, 22 bp, Artificial Sequence
  chemically synthesized
tctagtgcattttcatacacac

SEQ ID NO: 1401382 - DNA, 22 bp, Artificial Sequence
  chemically synthesized
ccccatgatgagtgtgtatgaa

SEQ ID NO: 1401383 - DNA, 22 bp, Artificial Sequence
  chemically synthesized
tctctctagtgcattttcatac

SEQ ID NO: 1401384 - DNA, 22 bp, Artificial Sequence
  chemically synthesized
tgtctctctagtgcattttcat

SEQ ID NO: 1401385 - DNA, 22 bp, Artificial Sequence
  chemically synthesized
ctgtctctctagtgcattttca

SEQ ID NO: 1401386 - DNA, 22 bp, Artificial Sequence
  chemically synthesized
atttctgtctctctagtgcatt

SEQ ID NO: 1401387 - DNA, 22 bp, Artificial Sequence
  chemically synthesized
catttctgtctctctagtgcat

SEQ ID NO: 1401388 - DNA, 22 bp, Artificial Sequence
  chemically synthesized
tcatttctgtctctctagtgca

SEQ ID NO: 1401389 - DNA, 22 bp, Artificial Sequence
  chemically synthesized
ttcatttctgtctctctagtgc

SEQ ID NO: 1401390 - DNA, 22 bp, Artificial Sequence
  chemically synthesized
atttttcatttctgtctctcta

SEQ ID NO: 1401391 - DNA, 22 bp, Artificial Sequence
  chemically synthesized
gagagacagaaatgaaaaatca

SEQ ID NO: 1401392 - DNA, 22 bp, Artificial Sequence
  chemically synthesized
agagcatggtgaggatggccct

SEQ ID NO: 1401393 - DNA, 22 bp, Artificial Sequence
  chemically synthesized
ataggagttcagagcatggtga

SEQ ID NO: 1401394 - DNA, 22 bp, Artificial Sequence
  chemically synthesized
accatgctctgaactcctatga

SEQ ID NO: 1401395 - DNA, 22 bp, Artificial Sequence
  chemically synthesized
tgaactcctatgagattcactt

SEQ ID NO: 1401396 - DNA, 22 bp, Artificial Sequence
  chemically synthesized
aaagaaagatgacaagtgaatc

SEQ ID NO: 1401397 - DNA, 22 bp, Artificial Sequence
  chemically synthesized
aactcctatgagattcacttgt

SEQ ID NO: 1401398 - DNA, 22 bp, Artificial Sequence
  chemically synthesized
aaaagaaagatgacaagtgaat

SEQ ID NO: 1401399 - DNA, 22 bp, Artificial Sequence
  chemically synthesized
taaaagaaagatgacaagtgaa

SEQ ID NO: 1401400 - DNA, 22 bp, Artificial Sequence
  chemically synthesized
ctatgagattcacttgtcatct

SEQ ID NO: 1401401 - DNA, 22 bp, Artificial Sequence
  chemically synthesized
tgagattcacttgtcatctttc

SEQ ID NO: 1401402 - DNA, 22 bp, Artificial Sequence
  chemically synthesized
acttgtcatctttcttttaaag

SEQ ID NO: 1401403 - DNA, 22 bp, Artificial Sequence
  chemically synthesized
gtcatctttcttttaaagatct

SEQ ID NO: 1401404 - DNA, 22 bp, Artificial Sequence
  chemically synthesized
tcatctttcttttaaagatctt

SEQ ID NO: 1401405 - DNA, 22 bp, Artificial Sequence
  chemically synthesized
tcttttaaagatcttatcgtgt

SEQ ID NO: 1401406 - DNA, 22 bp, Artificial Sequence
  chemically synthesized
cttttaaagatcttatcgtgta

SEQ ID NO: 1401407 - DNA, 22 bp, Artificial Sequence
  chemically synthesized
ttttaaagatcttatcgtgtat

SEQ ID NO: 1401408 - DNA, 22 bp, Artificial Sequence
  chemically synthesized
taatatcagataatacacgata

SEQ ID NO: 1401409 - DNA, 22 bp, Artificial Sequence
  chemically synthesized
ttaaagatcttatcgtgtatta

SEQ ID NO: 1401410 - DNA, 22 bp, Artificial Sequence
  chemically synthesized
taaagatcttatcgtgtattat

SEQ ID NO: 1401411 - DNA, 22 bp, Artificial Sequence
  chemically synthesized
aaagatcttatcgtgtattatc

SEQ ID NO: 1401412 - DNA, 22 bp, Artificial Sequence
  chemically synthesized
aagatcttatcgtgtattatct

SEQ ID NO: 1401413 - DNA, 22 bp, Artificial Sequence
  chemically synthesized
atcgtgtattatctgatattac

SEQ ID NO: 1401414 - DNA, 22 bp, Artificial Sequence
  chemically synthesized
tcgtgtattatctgatattaca

SEQ ID NO: 1401415 - DNA, 22 bp, Artificial Sequence
  chemically synthesized
ataatgggtaactgtaatatca

SEQ ID NO: 1401416 - DNA, 22 bp, Artificial Sequence
  chemically synthesized
ctcataatgggtaactgtaata

SEQ ID NO: 1401417 - DNA, 22 bp, Artificial Sequence
  chemically synthesized
tctgatattacagttacccatt

SEQ ID NO: 1401418 - DNA, 22 bp, Artificial Sequence
  chemically synthesized
tgataattcctcataatgggta

SEQ ID NO: 1401419 - DNA, 22 bp, Artificial Sequence
  chemically synthesized
atgataattcctcataatgggt

SEQ ID NO: 1401420 - DNA, 22 bp, Artificial Sequence
  chemically synthesized
atattacagttacccattatga

SEQ ID NO: 1401421 - DNA, 22 bp, Artificial Sequence
  chemically synthesized
tgcttatgataattcctcataa

SEQ ID NO: 1401422 - DNA, 22 bp, Artificial Sequence
  chemically synthesized
cagttacccattatgaggaatt

SEQ ID NO: 1401423 - DNA, 22 bp, Artificial Sequence
  chemically synthesized
cccattatgaggaattatcata

SEQ ID NO: 1401424 - DNA, 22 bp, Artificial Sequence
  chemically synthesized
tgaggaattatcataagcataa

SEQ ID NO: 1401425 - DNA, 22 bp, Artificial Sequence
  chemically synthesized
tcataagcataacctttatcat

SEQ ID NO: 1401426 - DNA, 22 bp, Artificial Sequence
  chemically synthesized
tgacgatgatagtaaaggtgat

SEQ ID NO: 1401427 - DNA, 22 bp, Artificial Sequence
  chemically synthesized
tatcatcattatcacctttact

SEQ ID NO: 1401428 - DNA, 22 bp, Artificial Sequence
  chemically synthesized
atcatcattatcacctttacta

SEQ ID NO: 1401429 - DNA, 22 bp, Artificial Sequence
  chemically synthesized
tcatcattatcacctttactat

SEQ ID NO: 1401430 - DNA, 22 bp, Artificial Sequence
  chemically synthesized
tctatgacgatgatagtaaagg

SEQ ID NO: 1401431 - DNA, 22 bp, Artificial Sequence
  chemically synthesized
catctgtctatgacgatgatag

SEQ ID NO: 1401432 - DNA, 22 bp, Artificial Sequence
  chemically synthesized
acatctgtctatgacgatgata

SEQ ID NO: 1401433 - DNA, 22 bp, Artificial Sequence
  chemically synthesized
tcacctttactatcatcgtcat

SEQ ID NO: 1401434 - DNA, 22 bp, Artificial Sequence
  chemically synthesized
gatttacatctgtctatgacga

SEQ ID NO: 1401435 - DNA, 22 bp, Artificial Sequence
  chemically synthesized
ctagatttacatctgtctatga

SEQ ID NO: 1401436 - DNA, 22 bp, Artificial Sequence
  chemically synthesized
tactatcatcgtcatagacaga

SEQ ID NO: 1401437 - DNA, 22 bp, Artificial Sequence
  chemically synthesized
actatcatcgtcatagacagat

SEQ ID NO: 1401438 - DNA, 22 bp, Artificial Sequence
  chemically synthesized
tgctagatttacatctgtctat

SEQ ID NO: 1401439 - DNA, 22 bp, Artificial Sequence
  chemically synthesized
ctatcatcgtcatagacagatg

SEQ ID NO: 1401440 - DNA, 22 bp, Artificial Sequence
  chemically synthesized
tcatcgtcatagacagatgtaa

SEQ ID NO: 1401441 - DNA, 22 bp, Artificial Sequence
  chemically synthesized
cattctgctagatttacatctg

SEQ ID NO: 1401442 - DNA, 22 bp, Artificial Sequence
  chemically synthesized
gcattctgctagatttacatct

SEQ ID NO: 1401443 - DNA, 22 bp, Artificial Sequence
  chemically synthesized
tatttgcattctgctagattta

SEQ ID NO: 1401444 - DNA, 22 bp, Artificial Sequence
  chemically synthesized
atatttgcattctgctagattt

SEQ ID NO: 1401445 - DNA, 22 bp, Artificial Sequence
  chemically synthesized
ttatatttgcattctgctagat

SEQ ID NO: 1401446 - DNA, 22 bp, Artificial Sequence
  chemically synthesized
cttatatttgcattctgctaga

SEQ ID NO: 1401447 - DNA, 22 bp, Artificial Sequence
  chemically synthesized
tcttatatttgcattctgctag

SEQ ID NO: 1401448 - DNA, 22 bp, Artificial Sequence
  chemically synthesized
gcagaatgcaaatataagaaaa

SEQ ID NO: 1401449 - DNA, 22 bp, Artificial Sequence
  chemically synthesized
cgtgagtcaggtcccattttct

SEQ ID NO: 1401450 - DNA, 22 bp, Artificial Sequence
  chemically synthesized
acgtgagtcaggtcccattttc

SEQ ID NO: 1401451 - DNA, 22 bp, Artificial Sequence
  chemically synthesized
ttacgtgagtcaggtcccattt

SEQ ID NO: 1401452 - DNA, 22 bp, Artificial Sequence
  chemically synthesized
cttacgtgagtcaggtcccatt

SEQ ID NO: 1401453 - DNA, 22 bp, Artificial Sequence
  chemically synthesized
aaagtcttcttacgtgagtcag

SEQ ID NO: 1401454 - DNA, 22 bp, Artificial Sequence
  chemically synthesized
caaagtcttcttacgtgagtca

SEQ ID NO: 1401455 - DNA, 22 bp, Artificial Sequence
  chemically synthesized
tcaaagtcttcttacgtgagtc

SEQ ID NO: 1401456 - DNA, 22 bp, Artificial Sequence
  chemically synthesized
actcacgtaagaagactttgaa

SEQ ID NO: 1401457 - DNA, 22 bp, Artificial Sequence
  chemically synthesized
atagaagaaaaactttcaaagt

SEQ ID NO: 1401458 - DNA, 22 bp, Artificial Sequence
  chemically synthesized
gatagaagaaaaactttcaaag

SEQ ID NO: 1401459 - DNA, 22 bp, Artificial Sequence
  chemically synthesized
acgtaagaagactttgaaagtt

SEQ ID NO: 1401460 - DNA, 22 bp, Artificial Sequence
  chemically synthesized
tgatagaagaaaaactttcaaa

SEQ ID NO: 1401461 - DNA, 22 bp, Artificial Sequence
  chemically synthesized
tcagattttgatagaagaaaaa

SEQ ID NO: 1401462 - DNA, 22 bp, Artificial Sequence
  chemically synthesized
gtcagattttgatagaagaaaa

SEQ ID NO: 1401463 - DNA, 22 bp, Artificial Sequence
  chemically synthesized
tgaaagtttttcttctatcaaa

SEQ ID NO: 1401464 - DNA, 22 bp, Artificial Sequence
  chemically synthesized
gaaagtttttcttctatcaaaa

SEQ ID NO: 1401465 - DNA, 22 bp, Artificial Sequence
  chemically synthesized
aaagtttttcttctatcaaaat

SEQ ID NO: 1401466 - DNA, 22 bp, Artificial Sequence
  chemically synthesized
agccaacttgtcagattttgat

SEQ ID NO: 1401467 - DNA, 22 bp, Artificial Sequence
  chemically synthesized
aagccaacttgtcagattttga

SEQ ID NO: 1401468 - DNA, 22 bp, Artificial Sequence
  chemically synthesized
taagccaacttgtcagattttg

SEQ ID NO: 1401469 - DNA, 22 bp, Artificial Sequence
  chemically synthesized
ttaagccaacttgtcagatttt

SEQ ID NO: 1401470 - DNA, 22 bp, Artificial Sequence
  chemically synthesized
ttcttctatcaaaatctgacaa

SEQ ID NO: 1401471 - DNA, 22 bp, Artificial Sequence
  chemically synthesized
tcttctatcaaaatctgacaag

SEQ ID NO: 1401472 - DNA, 22 bp, Artificial Sequence
  chemically synthesized
cttctatcaaaatctgacaagt

SEQ ID NO: 1401473 - DNA, 22 bp, Artificial Sequence
  chemically synthesized
ccttttaagccaacttgtcaga

SEQ ID NO: 1401474 - DNA, 22 bp, Artificial Sequence
  chemically synthesized
ttctatcaaaatctgacaagtt

SEQ ID NO: 1401475 - DNA, 22 bp, Artificial Sequence
  chemically synthesized
cccttttaagccaacttgtcag

SEQ ID NO: 1401476 - DNA, 22 bp, Artificial Sequence
  chemically synthesized
ctatcaaaatctgacaagttgg

SEQ ID NO: 1401477 - DNA, 22 bp, Artificial Sequence
  chemically synthesized
tatcaaaatctgacaagttggc

SEQ ID NO: 1401478 - DNA, 22 bp, Artificial Sequence
  chemically synthesized
tcaaaatctgacaagttggctt

SEQ ID NO: 1401479 - DNA, 22 bp, Artificial Sequence
  chemically synthesized
tgaacacatcttcccttttaag

SEQ ID NO: 1401480 - DNA, 22 bp, Artificial Sequence
  chemically synthesized
acaagttggcttaaaagggaag

SEQ ID NO: 1401481 - DNA, 22 bp, Artificial Sequence
  chemically synthesized
ttatgaacacatcttccctttt

SEQ ID NO: 1401482 - DNA, 22 bp, Artificial Sequence
  chemically synthesized
gcttaaaagggaagatgtgttc

SEQ ID NO: 1401483 - DNA, 22 bp, Artificial Sequence
  chemically synthesized
aaaagggaagatgtgttcataa

SEQ ID NO: 1401484 - DNA, 22 bp, Artificial Sequence
  chemically synthesized
aaagggaagatgtgttcataac

SEQ ID NO: 1401485 - DNA, 22 bp, Artificial Sequence
  chemically synthesized
ataacagtttctttcatttttt

SEQ ID NO: 1401486 - DNA, 22 bp, Artificial Sequence
  chemically synthesized
gccatggaaatggaaaaaatga

SEQ ID NO: 1401487 - DNA, 22 bp, Artificial Sequence
  chemically synthesized
ctttcattttttccatttccat

SEQ ID NO: 1401488 - DNA, 22 bp, Artificial Sequence
  chemically synthesized
tttcattttttccatttccatg

SEQ ID NO: 1401489 - DNA, 22 bp, Artificial Sequence
  chemically synthesized
caatgtaattagccatggaaat

SEQ ID NO: 1401490 - DNA, 22 bp, Artificial Sequence
  chemically synthesized
tcattttttccatttccatggc

SEQ ID NO: 1401491 - DNA, 22 bp, Artificial Sequence
  chemically synthesized
cattttttccatttccatggct

SEQ ID NO: 1401492 - DNA, 22 bp, Artificial Sequence
  chemically synthesized
attttttccatttccatggcta

SEQ ID NO: 1401493 - DNA, 22 bp, Artificial Sequence
  chemically synthesized
tttccatttccatggctaatta

SEQ ID NO: 1401494 - DNA, 22 bp, Artificial Sequence
  chemically synthesized
ttccatttccatggctaattac

SEQ ID NO: 1401495 - DNA, 22 bp, Artificial Sequence
  chemically synthesized
tccatttccatggctaattaca

SEQ ID NO: 1401496 - DNA, 22 bp, Artificial Sequence
  chemically synthesized
ccatttccatggctaattacat

SEQ ID NO: 1401497 - DNA, 22 bp, Artificial Sequence
  chemically synthesized
catttccatggctaattacatt

SEQ ID NO: 1401498 - DNA, 22 bp, Artificial Sequence
  chemically synthesized
atggagtattacaatgtaatta

SEQ ID NO: 1401499 - DNA, 22 bp, Artificial Sequence
  chemically synthesized
aatggagtattacaatgtaatt

SEQ ID NO: 1401500 - DNA, 22 bp, Artificial Sequence
  chemically synthesized
ccatggctaattacattgtaat

SEQ ID NO: 1401501 - DNA, 22 bp, Artificial Sequence
  chemically synthesized
ccttaatggagtattacaatgt

SEQ ID NO: 1401502 - DNA, 22 bp, Artificial Sequence
  chemically synthesized
catggctaattacattgtaata

SEQ ID NO: 1401503 - DNA, 22 bp, Artificial Sequence
  chemically synthesized
accttaatggagtattacaatg

SEQ ID NO: 1401504 - DNA, 22 bp, Artificial Sequence
  chemically synthesized
tatccttaccttaatggagtat

SEQ ID NO: 1401505 - DNA, 22 bp, Artificial Sequence
  chemically synthesized
attacattgtaatactccatta

SEQ ID NO: 1401506 - DNA, 22 bp, Artificial Sequence
  chemically synthesized
cattgtaatactccattaaggt

SEQ ID NO: 1401507 - DNA, 22 bp, Artificial Sequence
  chemically synthesized
taatactccattaaggtaagga

SEQ ID NO: 1401508 - DNA, 22 bp, Artificial Sequence
  chemically synthesized
accacaaacaatgctatatcct

SEQ ID NO: 1401509 - DNA, 22 bp, Artificial Sequence
  chemically synthesized
caccacaaacaatgctatatcc

SEQ ID NO: 1401510 - DNA, 22 bp, Artificial Sequence
  chemically synthesized
cattaaggtaaggatatagcat

SEQ ID NO: 1401511 - DNA, 22 bp, Artificial Sequence
  chemically synthesized
tttcaccacaaacaatgctata

SEQ ID NO: 1401512 - DNA, 22 bp, Artificial Sequence
  chemically synthesized
aggtaaggatatagcattgttt

SEQ ID NO: 1401513 - DNA, 22 bp, Artificial Sequence
  chemically synthesized
atggagagtctatttcaccaca

SEQ ID NO: 1401514 - DNA, 22 bp, Artificial Sequence
  chemically synthesized
ctcatggagagtctatttcacc

SEQ ID NO: 1401515 - DNA, 22 bp, Artificial Sequence
  chemically synthesized
ttgctcatggagagtctatttc

SEQ ID NO: 1401516 - DNA, 22 bp, Artificial Sequence
  chemically synthesized
tttgtggtgaaatagactctcc

SEQ ID NO: 1401517 - DNA, 22 bp, Artificial Sequence
  chemically synthesized
aattattgctcatggagagtct

SEQ ID NO: 1401518 - DNA, 22 bp, Artificial Sequence
  chemically synthesized
gtggtgaaatagactctccatg

SEQ ID NO: 1401519 - DNA, 22 bp, Artificial Sequence
  chemically synthesized
tggtgaaatagactctccatga

SEQ ID NO: 1401520 - DNA, 22 bp, Artificial Sequence
  chemically synthesized
aatctaaattattgctcatgga

SEQ ID NO: 1401521 - DNA, 22 bp, Artificial Sequence
  chemically synthesized
caatctaaattattgctcatgg

SEQ ID NO: 1401522 - DNA, 22 bp, Artificial Sequence
  chemically synthesized
tcaatctaaattattgctcatg

SEQ ID NO: 1401523 - DNA, 22 bp, Artificial Sequence
  chemically synthesized
ttcaatctaaattattgctcat

SEQ ID NO: 1401524 - DNA, 22 bp, Artificial Sequence
  chemically synthesized
tttcaatctaaattattgctca

SEQ ID NO: 1401525 - DNA, 22 bp, Artificial Sequence
  chemically synthesized
cctttttcaatctaaattattg

SEQ ID NO: 1401526 - DNA, 22 bp, Artificial Sequence
  chemically synthesized
acctttttcaatctaaattatt

SEQ ID NO: 1401527 - DNA, 22 bp, Artificial Sequence
  chemically synthesized
tacctttttcaatctaaattat

SEQ ID NO: 1401528 - DNA, 22 bp, Artificial Sequence
  chemically synthesized
tccatgagcaataatttagatt

SEQ ID NO: 1401529 - DNA, 22 bp, Artificial Sequence
  chemically synthesized
catgagcaataatttagattga

SEQ ID NO: 1401530 - DNA, 22 bp, Artificial Sequence
  chemically synthesized
tggaaatatatatattttacct

SEQ ID NO: 1401531 - DNA, 22 bp, Artificial Sequence
  chemically synthesized
agattgaaaaaggtaaaatata

SEQ ID NO: 1401532 - DNA, 22 bp, Artificial Sequence
  chemically synthesized
gattgaaaaaggtaaaatatat

SEQ ID NO: 1401533 - DNA, 22 bp, Artificial Sequence
  chemically synthesized
aaaaaggtaaaatatatatatt

SEQ ID NO: 1401534 - DNA, 22 bp, Artificial Sequence
  chemically synthesized
cataaagtaaactgtggaaata

SEQ ID NO: 1401535 - DNA, 22 bp, Artificial Sequence
  chemically synthesized
gcataaagtaaactgtggaaat

SEQ ID NO: 1401536 - DNA, 22 bp, Artificial Sequence
  chemically synthesized
catttgcataaagtaaactgtg

SEQ ID NO: 1401537 - DNA, 22 bp, Artificial Sequence
  chemically synthesized
actccatttgcataaagtaaac

SEQ ID NO: 1401538 - DNA, 22 bp, Artificial Sequence
  chemically synthesized
caactcactccatttgcataaa

SEQ ID NO: 1401539 - DNA, 22 bp, Artificial Sequence
  chemically synthesized
ccacagtttactttatgcaaat

SEQ ID NO: 1401540 - DNA, 22 bp, Artificial Sequence
  chemically synthesized
cacagtttactttatgcaaatg

SEQ ID NO: 1401541 - DNA, 22 bp, Artificial Sequence
  chemically synthesized
actttatgcaaatggagtgagt

SEQ ID NO: 1401542 - DNA, 22 bp, Artificial Sequence
  chemically synthesized
ctttatgcaaatggagtgagtt

SEQ ID NO: 1401543 - DNA, 22 bp, Artificial Sequence
  chemically synthesized
accaaaaattacaactcactcc

SEQ ID NO: 1401544 - DNA, 22 bp, Artificial Sequence
  chemically synthesized
tatgcaaatggagtgagttgta

SEQ ID NO: 1401545 - DNA, 22 bp, Artificial Sequence
  chemically synthesized
atgcaaatggagtgagttgtaa

SEQ ID NO: 1401546 - DNA, 22 bp, Artificial Sequence
  chemically synthesized
tgcaaatggagtgagttgtaat

SEQ ID NO: 1401547 - DNA, 22 bp, Artificial Sequence
  chemically synthesized
acccactcaccaaaaattacaa

SEQ ID NO: 1401548 - DNA, 22 bp, Artificial Sequence
  chemically synthesized
tcacccactcaccaaaaattac

SEQ ID NO: 1401549 - DNA, 22 bp, Artificial Sequence
  chemically synthesized
acctctcacccactcaccaaaa

SEQ ID NO: 1401550 - DNA, 22 bp, Artificial Sequence
  chemically synthesized
actgacctctcacccactcacc

SEQ ID NO: 1401551 - DNA, 22 bp, Artificial Sequence
  chemically synthesized
taatttttggtgagtgggtgag

SEQ ID NO: 1401552 - DNA, 22 bp, Artificial Sequence
  chemically synthesized
ttggtgagtgggtgagaggtca

SEQ ID NO: 1401553 - DNA, 22 bp, Artificial Sequence
  chemically synthesized
tggtgagtgggtgagaggtcag

SEQ ID NO: 1401554 - DNA, 22 bp, Artificial Sequence
  chemically synthesized
ggtgagtgggtgagaggtcagt

SEQ ID NO: 1401555 - DNA, 22 bp, Artificial Sequence
  chemically synthesized
gtgagtgggtgagaggtcagtt

SEQ ID NO: 1401556 - DNA, 22 bp, Artificial Sequence
  chemically synthesized
catacagtcatctaactgacct

SEQ ID NO: 1401557 - DNA, 22 bp, Artificial Sequence
  chemically synthesized
aattccatacagtcatctaact

SEQ ID NO: 1401558 - DNA, 22 bp, Artificial Sequence
  chemically synthesized
aaattccatacagtcatctaac

SEQ ID NO: 1401559 - DNA, 22 bp, Artificial Sequence
  chemically synthesized
taaattccatacagtcatctaa

SEQ ID NO: 1401560 - DNA, 22 bp, Artificial Sequence
  chemically synthesized
ttaaattccatacagtcatcta

SEQ ID NO: 1401561 - DNA, 22 bp, Artificial Sequence
  chemically synthesized
gatatttttaaattccatacag

SEQ ID NO: 1401562 - DNA, 22 bp, Artificial Sequence
  chemically synthesized
gatgactgtatggaatttaaaa

SEQ ID NO: 1401563 - DNA, 22 bp, Artificial Sequence
  chemically synthesized
tatggaatttaaaaatatccaa

SEQ ID NO: 1401564 - DNA, 22 bp, Artificial Sequence
  chemically synthesized
ccatatatgtaattggatattt

SEQ ID NO: 1401565 - DNA, 22 bp, Artificial Sequence
  chemically synthesized
atgctgccatatatgtaattgg

SEQ ID NO: 1401566 - DNA, 22 bp, Artificial Sequence
  chemically synthesized
tgatgctgccatatatgtaatt

SEQ ID NO: 1401567 - DNA, 22 bp, Artificial Sequence
  chemically synthesized
ctgatgctgccatatatgtaat

SEQ ID NO: 1401568 - DNA, 22 bp, Artificial Sequence
  chemically synthesized
aaaaatatccaattacatatat

SEQ ID NO: 1401569 - DNA, 22 bp, Artificial Sequence
  chemically synthesized
aaaatatccaattacatatatg

SEQ ID NO: 1401570 - DNA, 22 bp, Artificial Sequence
  chemically synthesized
aagagacttctgatgctgccat

SEQ ID NO: 1401571 - DNA, 22 bp, Artificial Sequence
  chemically synthesized
ctaaagagacttctgatgctgc

SEQ ID NO: 1401572 - DNA, 22 bp, Artificial Sequence
  chemically synthesized
catatatggcagcatcagaagt

SEQ ID NO: 1401573 - DNA, 22 bp, Artificial Sequence
  chemically synthesized
tgagagttgctaaagagacttc

SEQ ID NO: 1401574 - DNA, 22 bp, Artificial Sequence
  chemically synthesized
tacaatattgtgagagttgcta

SEQ ID NO: 1401575 - DNA, 22 bp, Artificial Sequence
  chemically synthesized
tatacaatattgtgagagttgc

SEQ ID NO: 1401576 - DNA, 22 bp, Artificial Sequence
  chemically synthesized
tctctatacaatattgtgagag

SEQ ID NO: 1401577 - DNA, 22 bp, Artificial Sequence
  chemically synthesized
atctctatacaatattgtgaga

SEQ ID NO: 1401578 - DNA, 22 bp, Artificial Sequence
  chemically synthesized
tatctctatacaatattgtgag

SEQ ID NO: 1401579 - DNA, 22 bp, Artificial Sequence
  chemically synthesized
ttatctctatacaatattgtga

SEQ ID NO: 1401580 - DNA, 22 bp, Artificial Sequence
  chemically synthesized
tttagcaactctcacaatattg

SEQ ID NO: 1401581 - DNA, 22 bp, Artificial Sequence
  chemically synthesized
tagcaactctcacaatattgta

SEQ ID NO: 1401582 - DNA, 22 bp, Artificial Sequence
  chemically synthesized
cttttatctctatacaatattg

SEQ ID NO: 1401583 - DNA, 22 bp, Artificial Sequence
  chemically synthesized
agcaactctcacaatattgtat

SEQ ID NO: 1401584 - DNA, 22 bp, Artificial Sequence
  chemically synthesized
gcaactctcacaatattgtata

SEQ ID NO: 1401585 - DNA, 22 bp, Artificial Sequence
  chemically synthesized
actgcttttatctctatacaat

SEQ ID NO: 1401586 - DNA, 22 bp, Artificial Sequence
  chemically synthesized
tctgactgcttttatctctata

SEQ ID NO: 1401587 - DNA, 22 bp, Artificial Sequence
  chemically synthesized
tcacaatattgtatagagataa

SEQ ID NO: 1401588 - DNA, 22 bp, Artificial Sequence
  chemically synthesized
acaatattgtatagagataaaa

SEQ ID NO: 1401589 - DNA, 22 bp, Artificial Sequence
  chemically synthesized
ccctgtctgactgcttttatct

SEQ ID NO: 1401590 - DNA, 22 bp, Artificial Sequence
  chemically synthesized
ttgccctgtctgactgctttta

SEQ ID NO: 1401591 - DNA, 22 bp, Artificial Sequence
  chemically synthesized
tatagagataaaagcagtcaga

SEQ ID NO: 1401592 - DNA, 22 bp, Artificial Sequence
  chemically synthesized
attattgccctgtctgactgct

SEQ ID NO: 1401593 - DNA, 22 bp, Artificial Sequence
  chemically synthesized
tgattattgccctgtctgactg

SEQ ID NO: 1401594 - DNA, 22 bp, Artificial Sequence
  chemically synthesized
taaatgagtaatatggctctga

SEQ ID NO: 1401595 - DNA, 22 bp, Artificial Sequence
  chemically synthesized
ataaatgagtaatatggctctg

SEQ ID NO: 1401596 - DNA, 22 bp, Artificial Sequence
  chemically synthesized
tataaatgagtaatatggctct

SEQ ID NO: 1401597 - DNA, 22 bp, Artificial Sequence
  chemically synthesized
agattttataaatgagtaatat

SEQ ID NO: 1401598 - DNA, 22 bp, Artificial Sequence
  chemically synthesized
attgagattttataaatgagta

SEQ ID NO: 1401599 - DNA, 22 bp, Artificial Sequence
  chemically synthesized
cattgagattttataaatgagt

SEQ ID NO: 1401600 - DNA, 22 bp, Artificial Sequence
  chemically synthesized
tcattgagattttataaatgag

SEQ ID NO: 1401601 - DNA, 22 bp, Artificial Sequence
  chemically synthesized
agagaaaattttcattgagatt

SEQ ID NO: 1401602 - DNA, 22 bp, Artificial Sequence
  chemically synthesized
ctcatttataaaatctcaatga

SEQ ID NO: 1401603 - DNA, 22 bp, Artificial Sequence
  chemically synthesized
atttataaaatctcaatgaaaa

SEQ ID NO: 1401604 - DNA, 22 bp, Artificial Sequence
  chemically synthesized
attcagagaaaattttcattga

SEQ ID NO: 1401605 - DNA, 22 bp, Artificial Sequence
  chemically synthesized
aattcagagaaaattttcattg

SEQ ID NO: 1401606 - DNA, 22 bp, Artificial Sequence
  chemically synthesized
ataaaatctcaatgaaaatttt

SEQ ID NO: 1401607 - DNA, 22 bp, Artificial Sequence
  chemically synthesized
taaaatctcaatgaaaattttc

SEQ ID NO: 1401608 - DNA, 22 bp, Artificial Sequence
  chemically synthesized
acgcttaattcagagaaaattt

SEQ ID NO: 1401609 - DNA, 22 bp, Artificial Sequence
  chemically synthesized
ttaacgcttaattcagagaaaa

SEQ ID NO: 1401610 - DNA, 22 bp, Artificial Sequence
  chemically synthesized
gttaacgcttaattcagagaaa

SEQ ID NO: 1401611 - DNA, 22 bp, Artificial Sequence
  chemically synthesized
tgttaacgcttaattcagagaa

SEQ ID NO: 1401612 - DNA, 22 bp, Artificial Sequence
  chemically synthesized
aatgaaaattttctctgaatta

SEQ ID NO: 1401613 - DNA, 22 bp, Artificial Sequence
  chemically synthesized
tttgttaacgcttaattcagag

SEQ ID NO: 1401614 - DNA, 22 bp, Artificial Sequence
  chemically synthesized
ctttgttaacgcttaattcaga

SEQ ID NO: 1401615 - DNA, 22 bp, Artificial Sequence
  chemically synthesized
atccttctttgttaacgcttaa

SEQ ID NO: 1401616 - DNA, 22 bp, Artificial Sequence
  chemically synthesized
tctctgaattaagcgttaacaa

SEQ ID NO: 1401617 - DNA, 22 bp, Artificial Sequence
  chemically synthesized
ctctgaattaagcgttaacaaa

SEQ ID NO: 1401618 - DNA, 22 bp, Artificial Sequence
  chemically synthesized
tctgaattaagcgttaacaaag

SEQ ID NO: 1401619 - DNA, 22 bp, Artificial Sequence
  chemically synthesized
agcctcatccttctttgttaac

SEQ ID NO: 1401620 - DNA, 22 bp, Artificial Sequence
  chemically synthesized
tgaattaagcgttaacaaagaa

SEQ ID NO: 1401621 - DNA, 22 bp, Artificial Sequence
  chemically synthesized
aattaagcgttaacaaagaagg

SEQ ID NO: 1401622 - DNA, 22 bp, Artificial Sequence
  chemically synthesized
agcgttaacaaagaaggatgag

SEQ ID NO: 1401623 - DNA, 22 bp, Artificial Sequence
  chemically synthesized
acaaagaaggatgaggctcaat

SEQ ID NO: 1401624 - DNA, 22 bp, Artificial Sequence
  chemically synthesized
tcgtaccatcacaattgagcct

SEQ ID NO: 1401625 - DNA, 22 bp, Artificial Sequence
  chemically synthesized
gtgtctgtcgtaccatcacaat

SEQ ID NO: 1401626 - DNA, 22 bp, Artificial Sequence
  chemically synthesized
ggtgtctgtcgtaccatcacaa

SEQ ID NO: 1401627 - DNA, 22 bp, Artificial Sequence
  chemically synthesized
gcatttggtgtctgtcgtacca

SEQ ID NO: 1401628 - DNA, 22 bp, Artificial Sequence
  chemically synthesized
aattgtgatggtacgacagaca

SEQ ID NO: 1401629 - DNA, 22 bp, Artificial Sequence
  chemically synthesized
taccattggcatttggtgtctg

SEQ ID NO: 1401630 - DNA, 22 bp, Artificial Sequence
  chemically synthesized
tgatggtacgacagacaccaaa

SEQ ID NO: 1401631 - DNA, 22 bp, Artificial Sequence
  chemically synthesized
aacgtattgtaccattggcatt

SEQ ID NO: 1401632 - DNA, 22 bp, Artificial Sequence
  chemically synthesized
tactaaacgtattgtaccattg

SEQ ID NO: 1401633 - DNA, 22 bp, Artificial Sequence
  chemically synthesized
agtacaattgccatacttctat

SEQ ID NO: 1401634 - DNA, 22 bp, Artificial Sequence
  chemically synthesized
gtacaattgccatacttctatg

SEQ ID NO: 1401635 - DNA, 22 bp, Artificial Sequence
  chemically synthesized
ccatacttctatgtgatgtttt

SEQ ID NO: 1401636 - DNA, 22 bp, Artificial Sequence
  chemically synthesized
caacatcatgataaaaacaaaa

SEQ ID NO: 1401637 - DNA, 22 bp, Artificial Sequence
  chemically synthesized
ctatgtgatgttttgtttttat

SEQ ID NO: 1401638 - DNA, 22 bp, Artificial Sequence
  chemically synthesized
tatgtgatgttttgtttttatc

SEQ ID NO: 1401639 - DNA, 22 bp, Artificial Sequence
  chemically synthesized
ctccaacatcatgataaaaaca

SEQ ID NO: 1401640 - DNA, 22 bp, Artificial Sequence
  chemically synthesized
tgtgatgttttgtttttatcat

SEQ ID NO: 1401641 - DNA, 22 bp, Artificial Sequence
  chemically synthesized
ttgctccaacatcatgataaaa

SEQ ID NO: 1401642 - DNA, 22 bp, Artificial Sequence
  chemically synthesized
tggctattgctccaacatcatg

SEQ ID NO: 1401643 - DNA, 22 bp, Artificial Sequence
  chemically synthesized
tgtttttatcatgatgttggag

SEQ ID NO: 1401644 - DNA, 22 bp, Artificial Sequence
  chemically synthesized
gtttttatcatgatgttggagc

SEQ ID NO: 1401645 - DNA, 22 bp, Artificial Sequence
  chemically synthesized
tttttatcatgatgttggagca

SEQ ID NO: 1401646 - DNA, 22 bp, Artificial Sequence
  chemically synthesized
tccctgtggctattgctccaac

SEQ ID NO: 1401647 - DNA, 22 bp, Artificial Sequence
  chemically synthesized
ttatcatgatgttggagcaata

SEQ ID NO: 1401648 - DNA, 22 bp, Artificial Sequence
  chemically synthesized
tgtccctgtggctattgctcca

SEQ ID NO: 1401649 - DNA, 22 bp, Artificial Sequence
  chemically synthesized
tatcatgatgttggagcaatag

SEQ ID NO: 1401650 - DNA, 22 bp, Artificial Sequence
  chemically synthesized
ctgtccctgtggctattgctcc

SEQ ID NO: 1401651 - DNA, 22 bp, Artificial Sequence
  chemically synthesized
atcatgatgttggagcaatagc

SEQ ID NO: 1401652 - DNA, 22 bp, Artificial Sequence
  chemically synthesized
tcatgatgttggagcaatagcc

SEQ ID NO: 1401653 - DNA, 22 bp, Artificial Sequence
  chemically synthesized
cttctgtccctgtggctattgc

SEQ ID NO: 1401654 - DNA, 22 bp, Artificial Sequence
  chemically synthesized
acttctgtccctgtggctattg

SEQ ID NO: 1401655 - DNA, 22 bp, Artificial Sequence
  chemically synthesized
acccgcttacttctgtccctgt

SEQ ID NO: 1401656 - DNA, 22 bp, Artificial Sequence
  chemically synthesized
gagcaatagccacagggacaga

SEQ ID NO: 1401657 - DNA, 22 bp, Artificial Sequence
  chemically synthesized
taacccgcttacttctgtccct

SEQ ID NO: 1401658 - DNA, 22 bp, Artificial Sequence
  chemically synthesized
ccctctaacccgcttacttctg

SEQ ID NO: 1401659 - DNA, 22 bp, Artificial Sequence
  chemically synthesized
accctctaacccgcttacttct

SEQ ID NO: 1401660 - DNA, 22 bp, Artificial Sequence
  chemically synthesized
taccctctaacccgcttacttc

SEQ ID NO: 1401661 - DNA, 22 bp, Artificial Sequence
  chemically synthesized
ttaccctctaacccgcttactt

SEQ ID NO: 1401662 - DNA, 22 bp, Artificial Sequence
  chemically synthesized
aacttttaccctctaacccgct

SEQ ID NO: 1401663 - DNA, 22 bp, Artificial Sequence
  chemically synthesized
attcaacttttaccctctaacc

SEQ ID NO: 1401664 - DNA, 22 bp, Artificial Sequence
  chemically synthesized
tacatattcattcaacttttac

SEQ ID NO: 1401665 - DNA, 22 bp, Artificial Sequence
  chemically synthesized
gagggtaaaagttgaatgaata

SEQ ID NO: 1401666 - DNA, 22 bp, Artificial Sequence
  chemically synthesized
caaggtatacctgtacatattc

SEQ ID NO: 1401667 - DNA, 22 bp, Artificial Sequence
  chemically synthesized
aatgaatatgtacaggtatacc

SEQ ID NO: 1401668 - DNA, 22 bp, Artificial Sequence
  chemically synthesized
cagtatctccaaggtatacctg

SEQ ID NO: 1401669 - DNA, 22 bp, Artificial Sequence
  chemically synthesized
aacctgcagtatctccaaggta

SEQ ID NO: 1401670 - DNA, 22 bp, Artificial Sequence
  chemically synthesized
gaactgaacctgcagtatctcc

SEQ ID NO: 1401671 - DNA, 22 bp, Artificial Sequence
  chemically synthesized
gtgatctggaactgaacctgca

SEQ ID NO: 1401672 - DNA, 22 bp, Artificial Sequence
  chemically synthesized
ggtgatctggaactgaacctgc

SEQ ID NO: 1401673 - DNA, 22 bp, Artificial Sequence
  chemically synthesized
tggtgatctggaactgaacctg

SEQ ID NO: 1401674 - DNA, 22 bp, Artificial Sequence
  chemically synthesized
ggagatactgcaggttcagttc

SEQ ID NO: 1401675 - DNA, 22 bp, Artificial Sequence
  chemically synthesized
gagatactgcaggttcagttcc

SEQ ID NO: 1401676 - DNA, 22 bp, Artificial Sequence
  chemically synthesized
ttttggtgatctggaactgaac

SEQ ID NO: 1401677 - DNA, 22 bp, Artificial Sequence
  chemically synthesized
attttggtgatctggaactgaa

SEQ ID NO: 1401678 - DNA, 22 bp, Artificial Sequence
  chemically synthesized
tattttggtgatctggaactga

SEQ ID NO: 1401679 - DNA, 22 bp, Artificial Sequence
  chemically synthesized
actttattttggtgatctggaa

SEQ ID NO: 1401680 - DNA, 22 bp, Artificial Sequence
  chemically synthesized
caggttcagttccagatcacca

SEQ ID NO: 1401681 - DNA, 22 bp, Artificial Sequence
  chemically synthesized
atgtgactcactttattttggt

SEQ ID NO: 1401682 - DNA, 22 bp, Artificial Sequence
  chemically synthesized
agttccagatcaccaaaataaa

SEQ ID NO: 1401683 - DNA, 22 bp, Artificial Sequence
  chemically synthesized
cagatcaccaaaataaagtgag

SEQ ID NO: 1401684 - DNA, 22 bp, Artificial Sequence
  chemically synthesized
ggaaaccgaataattcatgtga

SEQ ID NO: 1401685 - DNA, 22 bp, Artificial Sequence
  chemically synthesized
tatacactgggaaaccgaataa

SEQ ID NO: 1401686 - DNA, 22 bp, Artificial Sequence
  chemically synthesized
atatacactgggaaaccgaata

SEQ ID NO: 1401687 - DNA, 22 bp, Artificial Sequence
  chemically synthesized
tatatacactgggaaaccgaat

SEQ ID NO: 1401688 - DNA, 22 bp, Artificial Sequence
  chemically synthesized
ttatatacactgggaaaccgaa

SEQ ID NO: 1401689 - DNA, 22 bp, Artificial Sequence
  chemically synthesized
ttcggtttcccagtgtatataa

SEQ ID NO: 1401690 - DNA, 22 bp, Artificial Sequence
  chemically synthesized
ggtttcccagtgtatataaaag

SEQ ID NO: 1401691 - DNA, 22 bp, Artificial Sequence
  chemically synthesized
cccagtgtatataaaagttata

SEQ ID NO: 1401692 - DNA, 22 bp, Artificial Sequence
  chemically synthesized
ccagtgtatataaaagttatat

SEQ ID NO: 1401693 - DNA, 22 bp, Artificial Sequence
  chemically synthesized
caaaataatgtaaatataactt

SEQ ID NO: 1401694 - DNA, 22 bp, Artificial Sequence
  chemically synthesized
ggctacaaaataatgtaaatat

SEQ ID NO: 1401695 - DNA, 22 bp, Artificial Sequence
  chemically synthesized
aggctacaaaataatgtaaata

SEQ ID NO: 1401696 - DNA, 22 bp, Artificial Sequence
  chemically synthesized
cacacttaggctacaaaataat

SEQ ID NO: 1401697 - DNA, 22 bp, Artificial Sequence
  chemically synthesized
gcacacttaggctacaaaataa

SEQ ID NO: 1401698 - DNA, 22 bp, Artificial Sequence
  chemically synthesized
tgcacacttaggctacaaaata

SEQ ID NO: 1401699 - DNA, 22 bp, Artificial Sequence
  chemically synthesized
tatttacattattttgtagcct

SEQ ID NO: 1401700 - DNA, 22 bp, Artificial Sequence
  chemically synthesized
acattattttgtagcctaagtg

SEQ ID NO: 1401701 - DNA, 22 bp, Artificial Sequence
  chemically synthesized
cattattttgtagcctaagtgt

SEQ ID NO: 1401702 - DNA, 22 bp, Artificial Sequence
  chemically synthesized
acataatgctttgcacacttag

SEQ ID NO: 1401703 - DNA, 22 bp, Artificial Sequence
  chemically synthesized
aacataatgctttgcacactta

SEQ ID NO: 1401704 - DNA, 22 bp, Artificial Sequence
  chemically synthesized
taacataatgctttgcacactt

SEQ ID NO: 1401705 - DNA, 22 bp, Artificial Sequence
  chemically synthesized
ttttgtagcctaagtgtgcaaa

SEQ ID NO: 1401706 - DNA, 22 bp, Artificial Sequence
  chemically synthesized
ttaacataatgctttgcacact

SEQ ID NO: 1401707 - DNA, 22 bp, Artificial Sequence
  chemically synthesized
tttaacataatgctttgcacac

SEQ ID NO: 1401708 - DNA, 22 bp, Artificial Sequence
  chemically synthesized
tgtagcctaagtgtgcaaagca

SEQ ID NO: 1401709 - DNA, 22 bp, Artificial Sequence
  chemically synthesized
gtagcctaagtgtgcaaagcat

SEQ ID NO: 1401710 - DNA, 22 bp, Artificial Sequence
  chemically synthesized
tagcctaagtgtgcaaagcatt

SEQ ID NO: 1401711 - DNA, 22 bp, Artificial Sequence
  chemically synthesized
agtgtgcaaagcattatgttaa

SEQ ID NO: 1401712 - DNA, 22 bp, Artificial Sequence
  chemically synthesized
aggtatgtacattttttaacat

SEQ ID NO: 1401713 - DNA, 22 bp, Artificial Sequence
  chemically synthesized
ttaaggtatgtacattttttaa

SEQ ID NO: 1401714 - DNA, 22 bp, Artificial Sequence
  chemically synthesized
gttaaggtatgtacatttttta

SEQ ID NO: 1401715 - DNA, 22 bp, Artificial Sequence
  chemically synthesized
tgttaaggtatgtacatttttt

SEQ ID NO: 1401716 - DNA, 22 bp, Artificial Sequence
  chemically synthesized
ttgttaaggtatgtacattttt

SEQ ID NO: 1401717 - DNA, 22 bp, Artificial Sequence
  chemically synthesized
tgtttttgttaaggtatgtaca

SEQ ID NO: 1401718 - DNA, 22 bp, Artificial Sequence
  chemically synthesized
tgttaaaaaatgtacatacctt

SEQ ID NO: 1401719 - DNA, 22 bp, Artificial Sequence
  chemically synthesized
aaaaatgtacataccttaacaa

SEQ ID NO: 1401720 - DNA, 22 bp, Artificial Sequence
  chemically synthesized
gcaataaattatgtttttgtta

SEQ ID NO: 1401721 - DNA, 22 bp, Artificial Sequence
  chemically synthesized
agcaataaattatgtttttgtt

SEQ ID NO: 1401722 - DNA, 22 bp, Artificial Sequence
  chemically synthesized
tagcaataaattatgtttttgt

SEQ ID NO: 1401723 - DNA, 22 bp, Artificial Sequence
  chemically synthesized
ttagcaataaattatgtttttg

SEQ ID NO: 1401724 - DNA, 22 bp, Artificial Sequence
  chemically synthesized
tttagcaataaattatgttttt

SEQ ID NO: 1401725 - DNA, 22 bp, Artificial Sequence
  chemically synthesized
ttttagcaataaattatgtttt

SEQ ID NO: 1401726 - DNA, 22 bp, Artificial Sequence
  chemically synthesized
gcttttttagcaataaattatg

SEQ ID NO: 1401727 - DNA, 22 bp, Artificial Sequence
  chemically synthesized
ctagcttttttagcaataaatt

SEQ ID NO: 1401728 - DNA, 22 bp, Artificial Sequence
  chemically synthesized
aacaaaaacataatttattgct

SEQ ID NO: 1401729 - DNA, 22 bp, Artificial Sequence
  chemically synthesized
acaaaaacataatttattgcta

SEQ ID NO: 1401730 - DNA, 22 bp, Artificial Sequence
  chemically synthesized
agatgattgctagcttttttag

SEQ ID NO: 1401731 - DNA, 22 bp, Artificial Sequence
  chemically synthesized
aaggctcagatgattgctagct

SEQ ID NO: 1401732 - DNA, 22 bp, Artificial Sequence
  chemically synthesized
attgctaaaaaagctagcaatc

SEQ ID NO: 1401733 - DNA, 22 bp, Artificial Sequence
  chemically synthesized
ttgctaaaaaagctagcaatca

SEQ ID NO: 1401734 - DNA, 22 bp, Artificial Sequence
  chemically synthesized
actaaaggctcagatgattgct

SEQ ID NO: 1401735 - DNA, 22 bp, Artificial Sequence
  chemically synthesized
ctaaaaaagctagcaatcatct

SEQ ID NO: 1401736 - DNA, 22 bp, Artificial Sequence
  chemically synthesized
aaaaagctagcaatcatctgag

SEQ ID NO: 1401737 - DNA, 22 bp, Artificial Sequence
  chemically synthesized
caactcactaaaggctcagatg

SEQ ID NO: 1401738 - DNA, 22 bp, Artificial Sequence
  chemically synthesized
gcaatcatctgagcctttagtg

SEQ ID NO: 1401739 - DNA, 22 bp, Artificial Sequence
  chemically synthesized
gcaaaaagattacaactcacta

SEQ ID NO: 1401740 - DNA, 22 bp, Artificial Sequence
  chemically synthesized
cactagcaaaaagattacaact

SEQ ID NO: 1401741 - DNA, 22 bp, Artificial Sequence
  chemically synthesized
agcctttagtgagttgtaatct

SEQ ID NO: 1401742 - DNA, 22 bp, Artificial Sequence
  chemically synthesized
tagtgagttgtaatctttttgc

SEQ ID NO: 1401743 - DNA, 22 bp, Artificial Sequence
  chemically synthesized
agtgagttgtaatctttttgct

SEQ ID NO: 1401744 - DNA, 22 bp, Artificial Sequence
  chemically synthesized
gtgagttgtaatctttttgcta

SEQ ID NO: 1401745 - DNA, 22 bp, Artificial Sequence
  chemically synthesized
aggcaagagcctccactagcaa

SEQ ID NO: 1401746 - DNA, 22 bp, Artificial Sequence
  chemically synthesized
taatctttttgctagtggaggc

SEQ ID NO: 1401747 - DNA, 22 bp, Artificial Sequence
  chemically synthesized
tttgctagtggaggctcttgcc

SEQ ID NO: 1401748 - DNA, 22 bp, Artificial Sequence
  chemically synthesized
ttgctagtggaggctcttgcct

SEQ ID NO: 1401749 - DNA, 22 bp, Artificial Sequence
  chemically synthesized
tgctagtggaggctcttgcctc

SEQ ID NO: 1401750 - DNA, 22 bp, Artificial Sequence
  chemically synthesized
gctagtggaggctcttgcctca

SEQ ID NO: 1401751 - DNA, 22 bp, Artificial Sequence
  chemically synthesized
ctagtggaggctcttgcctcaa

SEQ ID NO: 1401752 - DNA, 22 bp, Artificial Sequence
  chemically synthesized
gtggaggctcttgcctcaatgt

SEQ ID NO: 1401753 - DNA, 22 bp, Artificial Sequence
  chemically synthesized
atcaatcagcagccatccacat

SEQ ID NO: 1401754 - DNA, 22 bp, Artificial Sequence
  chemically synthesized
ttgcctcaatgtggatggctgc

SEQ ID NO: 1401755 - DNA, 22 bp, Artificial Sequence
  chemically synthesized
gcctcaatgtggatggctgctg

SEQ ID NO: 1401756 - DNA, 22 bp, Artificial Sequence
  chemically synthesized
cctcaatgtggatggctgctga

SEQ ID NO: 1401757 - DNA, 22 bp, Artificial Sequence
  chemically synthesized
aatgtggatggctgctgattga

SEQ ID NO: 1401758 - DNA, 22 bp, Artificial Sequence
  chemically synthesized
agcaaccccaccctgatcaatc

SEQ ID NO: 1401759 - DNA, 22 bp, Artificial Sequence
  chemically synthesized
cagcaaccccaccctgatcaat

SEQ ID NO: 1401760 - DNA, 22 bp, Artificial Sequence
  chemically synthesized
ccaccttcagcaaccccaccct

SEQ ID NO: 1401761 - DNA, 22 bp, Artificial Sequence
  chemically synthesized
ctgattgatcagggtggggttg

SEQ ID NO: 1401762 - DNA, 22 bp, Artificial Sequence
  chemically synthesized
attgatcagggtggggttgctg

SEQ ID NO: 1401763 - DNA, 22 bp, Artificial Sequence
  chemically synthesized
atcagggtggggttgctgaagg

SEQ ID NO: 1401764 - DNA, 22 bp, Artificial Sequence
  chemically synthesized
tcacagtcactcccaccttcag

SEQ ID NO: 1401765 - DNA, 22 bp, Artificial Sequence
  chemically synthesized
caaagttgtcacagtcactccc

SEQ ID NO: 1401766 - DNA, 22 bp, Artificial Sequence
  chemically synthesized
acaaagttgtcacagtcactcc

SEQ ID NO: 1401767 - DNA, 22 bp, Artificial Sequence
  chemically synthesized
tacaaagttgtcacagtcactc

SEQ ID NO: 1401768 - DNA, 22 bp, Artificial Sequence
  chemically synthesized
ctgaaggtgggagtgactgtga

SEQ ID NO: 1401769 - DNA, 22 bp, Artificial Sequence
  chemically synthesized
ttttacaaagttgtcacagtca

SEQ ID NO: 1401770 - DNA, 22 bp, Artificial Sequence
  chemically synthesized
attttacaaagttgtcacagtc

SEQ ID NO: 1401771 - DNA, 22 bp, Artificial Sequence
  chemically synthesized
aaggtgggagtgactgtgacaa

SEQ ID NO: 1401772 - DNA, 22 bp, Artificial Sequence
  chemically synthesized
tcttattttacaaagttgtcac

SEQ ID NO: 1401773 - DNA, 22 bp, Artificial Sequence
  chemically synthesized
ttgtcttattttacaaagttgt

SEQ ID NO: 1401774 - DNA, 22 bp, Artificial Sequence
  chemically synthesized
attgttgtcttattttacaaag

SEQ ID NO: 1401775 - DNA, 22 bp, Artificial Sequence
  chemically synthesized
tgacaactttgtaaaataagac

SEQ ID NO: 1401776 - DNA, 22 bp, Artificial Sequence
  chemically synthesized
atgcagcaaaattcattgttgt

SEQ ID NO: 1401777 - DNA, 22 bp, Artificial Sequence
  chemically synthesized
tgtaaaataagacaacaatgaa

SEQ ID NO: 1401778 - DNA, 22 bp, Artificial Sequence
  chemically synthesized
gtaaaataagacaacaatgaat

SEQ ID NO: 1401779 - DNA, 22 bp, Artificial Sequence
  chemically synthesized
taaaataagacaacaatgaatt

SEQ ID NO: 1401780 - DNA, 22 bp, Artificial Sequence
  chemically synthesized
tgaaagaaagagtcaattgatg

SEQ ID NO: 1401781 - DNA, 22 bp, Artificial Sequence
  chemically synthesized
gtgaaagaaagagtcaattgat

SEQ ID NO: 1401782 - DNA, 22 bp, Artificial Sequence
  chemically synthesized
tgtgaaagaaagagtcaattga

SEQ ID NO: 1401783 - DNA, 22 bp, Artificial Sequence
  chemically synthesized
tgctgcatcaattgactctttc

SEQ ID NO: 1401784 - DNA, 22 bp, Artificial Sequence
  chemically synthesized
gctgcatcaattgactctttct

SEQ ID NO: 1401785 - DNA, 22 bp, Artificial Sequence
  chemically synthesized
ctgcatcaattgactctttctt

SEQ ID NO: 1401786 - DNA, 22 bp, Artificial Sequence
  chemically synthesized
catcaattgactctttctttca

SEQ ID NO: 1401787 - DNA, 22 bp, Artificial Sequence
  chemically synthesized
caaagaaatgttttgtgaaaga

SEQ ID NO: 1401788 - DNA, 22 bp, Artificial Sequence
  chemically synthesized
actctttctttcacaaaacatt

SEQ ID NO: 1401789 - DNA, 22 bp, Artificial Sequence
  chemically synthesized
tttctttcacaaaacatttctt

SEQ ID NO: 1401790 - DNA, 22 bp, Artificial Sequence
  chemically synthesized
tctttcacaaaacatttctttg

SEQ ID NO: 1401791 - DNA, 22 bp, Artificial Sequence
  chemically synthesized
ctttcacaaaacatttctttgt

SEQ ID NO: 1401792 - DNA, 22 bp, Artificial Sequence
  chemically synthesized
tttcacaaaacatttctttgta

SEQ ID NO: 1401793 - DNA, 22 bp, Artificial Sequence
  chemically synthesized
tcacaaaacatttctttgtagc

SEQ ID NO: 1401794 - DNA, 22 bp, Artificial Sequence
  chemically synthesized
cacaaaacatttctttgtagca

SEQ ID NO: 1401795 - DNA, 22 bp, Artificial Sequence
  chemically synthesized
acaaaacatttctttgtagcat

SEQ ID NO: 1401796 - DNA, 22 bp, Artificial Sequence
  chemically synthesized
tcaaacagcagcacatgctaca

SEQ ID NO: 1401797 - DNA, 22 bp, Artificial Sequence
  chemically synthesized
ctttgtagcatgtgctgctgtt

SEQ ID NO: 1401798 - DNA, 22 bp, Artificial Sequence
  chemically synthesized
tttgtagcatgtgctgctgttt

SEQ ID NO: 1401799 - DNA, 22 bp, Artificial Sequence
  chemically synthesized
tgtagcatgtgctgctgtttga

SEQ ID NO: 1401800 - DNA, 22 bp, Artificial Sequence
  chemically synthesized
gtagcatgtgctgctgtttgat

SEQ ID NO: 1401801 - DNA, 22 bp, Artificial Sequence
  chemically synthesized
tagcatgtgctgctgtttgata

SEQ ID NO: 1401802 - DNA, 22 bp, Artificial Sequence
  chemically synthesized
tgagtaaagtgctatcaaacag

SEQ ID NO: 1401803 - DNA, 22 bp, Artificial Sequence
  chemically synthesized
ctgtgagtaaagtgctatcaaa

SEQ ID NO: 1401804 - DNA, 22 bp, Artificial Sequence
  chemically synthesized
tactgtgagtaaagtgctatca

SEQ ID NO: 1401805 - DNA, 22 bp, Artificial Sequence
  chemically synthesized
ctgtttgatagcactttactca

SEQ ID NO: 1401806 - DNA, 22 bp, Artificial Sequence
  chemically synthesized
tttgatagcactttactcacag

SEQ ID NO: 1401807 - DNA, 22 bp, Artificial Sequence
  chemically synthesized
aaagaagttctactgtgagtaa

SEQ ID NO: 1401808 - DNA, 22 bp, Artificial Sequence
  chemically synthesized
gaaagaagttctactgtgagta

SEQ ID NO: 1401809 - DNA, 22 bp, Artificial Sequence
  chemically synthesized
tgaaagaagttctactgtgagt

SEQ ID NO: 1401810 - DNA, 22 bp, Artificial Sequence
  chemically synthesized
gatagcactttactcacagtag

SEQ ID NO: 1401811 - DNA, 22 bp, Artificial Sequence
  chemically synthesized
atagcactttactcacagtaga

SEQ ID NO: 1401812 - DNA, 22 bp, Artificial Sequence
  chemically synthesized
caattttgaaagaagttctact

SEQ ID NO: 1401813 - DNA, 22 bp, Artificial Sequence
  chemically synthesized
actccaattttgaaagaagttc

SEQ ID NO: 1401814 - DNA, 22 bp, Artificial Sequence
  chemically synthesized
tactcacagtagaacttctttc

SEQ ID NO: 1401815 - DNA, 22 bp, Artificial Sequence
  chemically synthesized
actcacagtagaacttctttca

SEQ ID NO: 1401816 - DNA, 22 bp, Artificial Sequence
  chemically synthesized
ctcacagtagaacttctttcaa

SEQ ID NO: 1401817 - DNA, 22 bp, Artificial Sequence
  chemically synthesized
acagtagaacttctttcaaaat

SEQ ID NO: 1401818 - DNA, 22 bp, Artificial Sequence
  chemically synthesized
agaagactgactccaattttga

SEQ ID NO: 1401819 - DNA, 22 bp, Artificial Sequence
  chemically synthesized
gagaagactgactccaattttg

SEQ ID NO: 1401820 - DNA, 22 bp, Artificial Sequence
  chemically synthesized
ctttcaaaattggagtcagtct

SEQ ID NO: 1401821 - DNA, 22 bp, Artificial Sequence
  chemically synthesized
tttcaaaattggagtcagtctt

SEQ ID NO: 1401822 - DNA, 22 bp, Artificial Sequence
  chemically synthesized
tcaaaattggagtcagtcttct

SEQ ID NO: 1401823 - DNA, 22 bp, Artificial Sequence
  chemically synthesized
caaaattggagtcagtcttctc

SEQ ID NO: 1401824 - DNA, 22 bp, Artificial Sequence
  chemically synthesized
aaaattggagtcagtcttctca

SEQ ID NO: 1401825 - DNA, 22 bp, Artificial Sequence
  chemically synthesized
gagtcagtcttctcaaattctg

SEQ ID NO: 1401826 - DNA, 22 bp, Artificial Sequence
  chemically synthesized
ataaagtagtggcagaatttga

SEQ ID NO: 1401827 - DNA, 22 bp, Artificial Sequence
  chemically synthesized
gctgataaagtagtggcagaat

SEQ ID NO: 1401828 - DNA, 22 bp, Artificial Sequence
  chemically synthesized
agctgataaagtagtggcagaa

SEQ ID NO: 1401829 - DNA, 22 bp, Artificial Sequence
  chemically synthesized
ctcaaattctgccactacttta

SEQ ID NO: 1401830 - DNA, 22 bp, Artificial Sequence
  chemically synthesized
tcaaattctgccactactttat

SEQ ID NO: 1401831 - DNA, 22 bp, Artificial Sequence
  chemically synthesized
aaattctgccactactttatca

SEQ ID NO: 1401832 - DNA, 22 bp, Artificial Sequence
  chemically synthesized
cacatacttagctgataaagta

SEQ ID NO: 1401833 - DNA, 22 bp, Artificial Sequence
  chemically synthesized
tgccactactttatcagctaag

SEQ ID NO: 1401834 - DNA, 22 bp, Artificial Sequence
  chemically synthesized
ccactactttatcagctaagta

SEQ ID NO: 1401835 - DNA, 22 bp, Artificial Sequence
  chemically synthesized
gaatattacacatacttagctg

SEQ ID NO: 1401836 - DNA, 22 bp, Artificial Sequence
  chemically synthesized
agaatattacacatacttagct

SEQ ID NO: 1401837 - DNA, 22 bp, Artificial Sequence
  chemically synthesized
ctttatcagctaagtatgtgta

SEQ ID NO: 1401838 - DNA, 22 bp, Artificial Sequence
  chemically synthesized
tatcagctaagtatgtgtaata

SEQ ID NO: 1401839 - DNA, 22 bp, Artificial Sequence
  chemically synthesized
atcagctaagtatgtgtaatat

SEQ ID NO: 1401840 - DNA, 22 bp, Artificial Sequence
  chemically synthesized
tcagctaagtatgtgtaatatt

SEQ ID NO: 1401841 - DNA, 22 bp, Artificial Sequence
  chemically synthesized
agtatgtgtaatattctaaatc

SEQ ID NO: 1401842 - DNA, 22 bp, Artificial Sequence
  chemically synthesized
agatgacaacaaaggatttaga

SEQ ID NO: 1401843 - DNA, 22 bp, Artificial Sequence
  chemically synthesized
ttgagatgacaacaaaggattt

SEQ ID NO: 1401844 - DNA, 22 bp, Artificial Sequence
  chemically synthesized
agaacattgttgagatgacaac

SEQ ID NO: 1401845 - DNA, 22 bp, Artificial Sequence
  chemically synthesized
taaatcctttgttgtcatctca

SEQ ID NO: 1401846 - DNA, 22 bp, Artificial Sequence
  chemically synthesized
aatcctttgttgtcatctcaac

SEQ ID NO: 1401847 - DNA, 22 bp, Artificial Sequence
  chemically synthesized
tgttgtcatctcaacaatgttc

SEQ ID NO: 1401848 - DNA, 22 bp, Artificial Sequence
  chemically synthesized
gttgtcatctcaacaatgttct

SEQ ID NO: 1401849 - DNA, 22 bp, Artificial Sequence
  chemically synthesized
gtgaagatgctgagaacattgt

SEQ ID NO: 1401850 - DNA, 22 bp, Artificial Sequence
  chemically synthesized
ttgtcatctcaacaatgttctc

SEQ ID NO: 1401851 - DNA, 22 bp, Artificial Sequence
  chemically synthesized
tggtgaagatgctgagaacatt

SEQ ID NO: 1401852 - DNA, 22 bp, Artificial Sequence
  chemically synthesized
ctggtgaagatgctgagaacat

SEQ ID NO: 1401853 - DNA, 22 bp, Artificial Sequence
  chemically synthesized
tcatctcaacaatgttctcagc

SEQ ID NO: 1401854 - DNA, 22 bp, Artificial Sequence
  chemically synthesized
cttctggtgaagatgctgagaa

SEQ ID NO: 1401855 - DNA, 22 bp, Artificial Sequence
  chemically synthesized
acttctggtgaagatgctgaga

SEQ ID NO: 1401856 - DNA, 22 bp, Artificial Sequence
  chemically synthesized
aacaatgttctcagcatcttca

SEQ ID NO: 1401857 - DNA, 22 bp, Artificial Sequence
  chemically synthesized
agataaaatttacttctggtga

SEQ ID NO: 1401858 - DNA, 22 bp, Artificial Sequence
  chemically synthesized
gagataaaatttacttctggtg

SEQ ID NO: 1401859 - DNA, 22 bp, Artificial Sequence
  chemically synthesized
tcagcatcttcaccagaagtaa

SEQ ID NO: 1401860 - DNA, 22 bp, Artificial Sequence
  chemically synthesized
ttgagataaaatttacttctgg

SEQ ID NO: 1401861 - DNA, 22 bp, Artificial Sequence
  chemically synthesized
cttgagataaaatttacttctg

SEQ ID NO: 1401862 - DNA, 22 bp, Artificial Sequence
  chemically synthesized
agcatcttcaccagaagtaaat

SEQ ID NO: 1401863 - DNA, 22 bp, Artificial Sequence
  chemically synthesized
tcttgagataaaatttacttct

SEQ ID NO: 1401864 - DNA, 22 bp, Artificial Sequence
  chemically synthesized
caccagaagtaaattttatctc

SEQ ID NO: 1401865 - DNA, 22 bp, Artificial Sequence
  chemically synthesized
accagaagtaaattttatctca

SEQ ID NO: 1401866 - DNA, 22 bp, Artificial Sequence
  chemically synthesized
atggatgagcaaagaaagtgct

SEQ ID NO: 1401867 - DNA, 22 bp, Artificial Sequence
  chemically synthesized
tatctcaagaaagcactttctt

SEQ ID NO: 1401868 - DNA, 22 bp, Artificial Sequence
  chemically synthesized
atctcaagaaagcactttcttt

SEQ ID NO: 1401869 - DNA, 22 bp, Artificial Sequence
  chemically synthesized
tctcaagaaagcactttctttg

SEQ ID NO: 1401870 - DNA, 22 bp, Artificial Sequence
  chemically synthesized
catctgatggatgagcaaagaa

SEQ ID NO: 1401871 - DNA, 22 bp, Artificial Sequence
  chemically synthesized
aagaaagcactttctttgctca

SEQ ID NO: 1401872 - DNA, 22 bp, Artificial Sequence
  chemically synthesized
tctttgctcatccatcagatgc

SEQ ID NO: 1401873 - DNA, 22 bp, Artificial Sequence
  chemically synthesized
ctttgctcatccatcagatgca

SEQ ID NO: 1401874 - DNA, 22 bp, Artificial Sequence
  chemically synthesized
tttgctcatccatcagatgcaa

SEQ ID NO: 1401875 - DNA, 22 bp, Artificial Sequence
  chemically synthesized
tgctcatccatcagatgcaatt

SEQ ID NO: 1401876 - DNA, 22 bp, Artificial Sequence
  chemically synthesized
gctcatccatcagatgcaattc

SEQ ID NO: 1401877 - DNA, 22 bp, Artificial Sequence
  chemically synthesized
ctcatccatcagatgcaattcc

SEQ ID NO: 1401878 - DNA, 22 bp, Artificial Sequence
  chemically synthesized
atccatcagatgcaattcctca

SEQ ID NO: 1401879 - DNA, 22 bp, Artificial Sequence
  chemically synthesized
ataataaagcgtgaatggatga

SEQ ID NO: 1401880 - DNA, 22 bp, Artificial Sequence
  chemically synthesized
aaatctcataataaagcgtgaa

SEQ ID NO: 1401881 - DNA, 22 bp, Artificial Sequence
  chemically synthesized
ctaaaatctcataataaagcgt

SEQ ID NO: 1401882 - DNA, 22 bp, Artificial Sequence
  chemically synthesized
ctcatccattcacgctttatta

SEQ ID NO: 1401883 - DNA, 22 bp, Artificial Sequence
  chemically synthesized
atccattcacgctttattatga

SEQ ID NO: 1401884 - DNA, 22 bp, Artificial Sequence
  chemically synthesized
aattcctaaaatctcataataa

SEQ ID NO: 1401885 - DNA, 22 bp, Artificial Sequence
  chemically synthesized
ctgaattcctaaaatctcataa

SEQ ID NO: 1401886 - DNA, 22 bp, Artificial Sequence
  chemically synthesized
acgctttattatgagattttag

SEQ ID NO: 1401887 - DNA, 22 bp, Artificial Sequence
  chemically synthesized
aagatgttgctgaattcctaaa

SEQ ID NO: 1401888 - DNA, 22 bp, Artificial Sequence
  chemically synthesized
tattatgagattttaggaattc

SEQ ID NO: 1401889 - DNA, 22 bp, Artificial Sequence
  chemically synthesized
attatgagattttaggaattca

SEQ ID NO: 1401890 - DNA, 22 bp, Artificial Sequence
  chemically synthesized
ttatgagattttaggaattcag

SEQ ID NO: 1401891 - DNA, 22 bp, Artificial Sequence
  chemically synthesized
tgagattttaggaattcagcaa

SEQ ID NO: 1401892 - DNA, 22 bp, Artificial Sequence
  chemically synthesized
taggaattcagcaacatcttca

SEQ ID NO: 1401893 - DNA, 22 bp, Artificial Sequence
  chemically synthesized
aggaattcagcaacatcttcag

SEQ ID NO: 1401894 - DNA, 22 bp, Artificial Sequence
  chemically synthesized
ggaattcagcaacatcttcagg

SEQ ID NO: 1401895 - DNA, 22 bp, Artificial Sequence
  chemically synthesized
aaatgagaagtggagcctgaag

SEQ ID NO: 1401896 - DNA, 22 bp, Artificial Sequence
  chemically synthesized
agcaacatcttcaggctccact

SEQ ID NO: 1401897 - DNA, 22 bp, Artificial Sequence
  chemically synthesized
caggctccacttctcattttaa

SEQ ID NO: 1401898 - DNA, 22 bp, Artificial Sequence
  chemically synthesized
aggctccacttctcattttaat

SEQ ID NO: 1401899 - DNA, 22 bp, Artificial Sequence
  chemically synthesized
cacttctcattttaattctctt

SEQ ID NO: 1401900 - DNA, 22 bp, Artificial Sequence
  chemically synthesized
ctcattttaattctcttgctat

SEQ ID NO: 1401901 - DNA, 22 bp, Artificial Sequence
  chemically synthesized
tcattttaattctcttgctatt

SEQ ID NO: 1401902 - DNA, 22 bp, Artificial Sequence
  chemically synthesized
gagatatggtgacaatagcaag

SEQ ID NO: 1401903 - DNA, 22 bp, Artificial Sequence
  chemically synthesized
attttaattctcttgctattgt

SEQ ID NO: 1401904 - DNA, 22 bp, Artificial Sequence
  chemically synthesized
taattctcttgctattgtcacc

SEQ ID NO: 1401905 - DNA, 22 bp, Artificial Sequence
  chemically synthesized
aattctcttgctattgtcacca

SEQ ID NO: 1401906 - DNA, 22 bp, Artificial Sequence
  chemically synthesized
attctcttgctattgtcaccat

SEQ ID NO: 1401907 - DNA, 22 bp, Artificial Sequence
  chemically synthesized
tcttgctattgtcaccatatct

SEQ ID NO: 1401908 - DNA, 22 bp, Artificial Sequence
  chemically synthesized
ttgctattgtcaccatatctcc

SEQ ID NO: 1401909 - DNA, 22 bp, Artificial Sequence
  chemically synthesized
gaagaagtcactggagatatgg

SEQ ID NO: 1401910 - DNA, 22 bp, Artificial Sequence
  chemically synthesized
gctattgtcaccatatctccag

SEQ ID NO: 1401911 - DNA, 22 bp, Artificial Sequence
  chemically synthesized
ctattgtcaccatatctccagt

SEQ ID NO: 1401912 - DNA, 22 bp, Artificial Sequence
  chemically synthesized
ttgtcaccatatctccagtgac

SEQ ID NO: 1401913 - DNA, 22 bp, Artificial Sequence
  chemically synthesized
tcactggaagaagtcactggag

SEQ ID NO: 1401914 - DNA, 22 bp, Artificial Sequence
  chemically synthesized
tcaccatatctccagtgacttc

SEQ ID NO: 1401915 - DNA, 22 bp, Artificial Sequence
  chemically synthesized
aagttgtcactggaagaagtca

SEQ ID NO: 1401916 - DNA, 22 bp, Artificial Sequence
  chemically synthesized
aggagctcaagttgtcactgga

SEQ ID NO: 1401917 - DNA, 22 bp, Artificial Sequence
  chemically synthesized
cagtgacttcttccagtgacaa

SEQ ID NO: 1401918 - DNA, 22 bp, Artificial Sequence
  chemically synthesized
aaggagctcaagttgtcactgg

SEQ ID NO: 1401919 - DNA, 22 bp, Artificial Sequence
  chemically synthesized
taaggagctcaagttgtcactg

SEQ ID NO: 1401920 - DNA, 22 bp, Artificial Sequence
  chemically synthesized
cttccagtgacaacttgagctc

SEQ ID NO: 1401921 - DNA, 22 bp, Artificial Sequence
  chemically synthesized
ttccagtgacaacttgagctcc

SEQ ID NO: 1401922 - DNA, 22 bp, Artificial Sequence
  chemically synthesized
ccagtgacaacttgagctcctt

SEQ ID NO: 1401923 - DNA, 22 bp, Artificial Sequence
  chemically synthesized
atggatgactttaaggagctca

SEQ ID NO: 1401924 - DNA, 22 bp, Artificial Sequence
  chemically synthesized
cagtgacaacttgagctcctta

SEQ ID NO: 1401925 - DNA, 22 bp, Artificial Sequence
  chemically synthesized
aaccctcatggatgactttaag

SEQ ID NO: 1401926 - DNA, 22 bp, Artificial Sequence
  chemically synthesized
caaccctcatggatgactttaa

SEQ ID NO: 1401927 - DNA, 22 bp, Artificial Sequence
  chemically synthesized
atttcaaccctcatggatgact

SEQ ID NO: 1401928 - DNA, 22 bp, Artificial Sequence
  chemically synthesized
gagctccttaaagtcatccatg

SEQ ID NO: 1401929 - DNA, 22 bp, Artificial Sequence
  chemically synthesized
agctccttaaagtcatccatga

SEQ ID NO: 1401930 - DNA, 22 bp, Artificial Sequence
  chemically synthesized
cttaaagtcatccatgagggtt

SEQ ID NO: 1401931 - DNA, 22 bp, Artificial Sequence
  chemically synthesized
aaagtcatccatgagggttgaa

SEQ ID NO: 1401932 - DNA, 22 bp, Artificial Sequence
  chemically synthesized
gaagaagctgatttcaaccctc

SEQ ID NO: 1401933 - DNA, 22 bp, Artificial Sequence
  chemically synthesized
aagtcatccatgagggttgaaa

SEQ ID NO: 1401934 - DNA, 22 bp, Artificial Sequence
  chemically synthesized
agaagaagctgatttcaaccct

SEQ ID NO: 1401935 - DNA, 22 bp, Artificial Sequence
  chemically synthesized
acaggagtttagaagaagctga

SEQ ID NO: 1401936 - DNA, 22 bp, Artificial Sequence
  chemically synthesized
aacaggagtttagaagaagctg

SEQ ID NO: 1401937 - DNA, 22 bp, Artificial Sequence
  chemically synthesized
aaatcagcttcttctaaactcc

SEQ ID NO: 1401938 - DNA, 22 bp, Artificial Sequence
  chemically synthesized
cttctaaactcctgttaaatgt

SEQ ID NO: 1401939 - DNA, 22 bp, Artificial Sequence
  chemically synthesized
ttctaaactcctgttaaatgtg

SEQ ID NO: 1401940 - DNA, 22 bp, Artificial Sequence
  chemically synthesized
ctaaactcctgttaaatgtgat

SEQ ID NO: 1401941 - DNA, 22 bp, Artificial Sequence
  chemically synthesized
taaactcctgttaaatgtgata

SEQ ID NO: 1401942 - DNA, 22 bp, Artificial Sequence
  chemically synthesized
aactcctgttaaatgtgatatt

SEQ ID NO: 1401943 - DNA, 22 bp, Artificial Sequence
  chemically synthesized
atcggaggaggtcaaaatatca

SEQ ID NO: 1401944 - DNA, 22 bp, Artificial Sequence
  chemically synthesized
ctgttaaatgtgatattttgac

SEQ ID NO: 1401945 - DNA, 22 bp, Artificial Sequence
  chemically synthesized
ttaaatgtgatattttgacctc

SEQ ID NO: 1401946 - DNA, 22 bp, Artificial Sequence
  chemically synthesized
atgattcatcggaggaggtcaa

SEQ ID NO: 1401947 - DNA, 22 bp, Artificial Sequence
  chemically synthesized
aatgtgatattttgacctcctc

SEQ ID NO: 1401948 - DNA, 22 bp, Artificial Sequence
  chemically synthesized
ataacattcatgattcatcgga

SEQ ID NO: 1401949 - DNA, 22 bp, Artificial Sequence
  chemically synthesized
tgacctcctccgatgaatcatg

SEQ ID NO: 1401950 - DNA, 22 bp, Artificial Sequence
  chemically synthesized
gacctcctccgatgaatcatga

SEQ ID NO: 1401951 - DNA, 22 bp, Artificial Sequence
  chemically synthesized
acctcctccgatgaatcatgaa

SEQ ID NO: 1401952 - DNA, 22 bp, Artificial Sequence
  chemically synthesized
gatgccattaataacattcatg

SEQ ID NO: 1401953 - DNA, 22 bp, Artificial Sequence
  chemically synthesized
ctccgatgaatcatgaatgtta

SEQ ID NO: 1401954 - DNA, 22 bp, Artificial Sequence
  chemically synthesized
tagatgccattaataacattca

SEQ ID NO: 1401955 - DNA, 22 bp, Artificial Sequence
  chemically synthesized
cgatgaatcatgaatgttatta

SEQ ID NO: 1401956 - DNA, 22 bp, Artificial Sequence
  chemically synthesized
accattctagatgccattaata

SEQ ID NO: 1401957 - DNA, 22 bp, Artificial Sequence
  chemically synthesized
taaggaattcaccattctagat

SEQ ID NO: 1401958 - DNA, 22 bp, Artificial Sequence
  chemically synthesized
tgtaaggaattcaccattctag

SEQ ID NO: 1401959 - DNA, 22 bp, Artificial Sequence
  chemically synthesized
ctgtaaggaattcaccattcta

SEQ ID NO: 1401960 - DNA, 22 bp, Artificial Sequence
  chemically synthesized
ttaatggcatctagaatggtga

SEQ ID NO: 1401961 - DNA, 22 bp, Artificial Sequence
  chemically synthesized
atggcatctagaatggtgaatt

SEQ ID NO: 1401962 - DNA, 22 bp, Artificial Sequence
  chemically synthesized
aaagccttctgtaaggaattca

SEQ ID NO: 1401963 - DNA, 22 bp, Artificial Sequence
  chemically synthesized
gaatggtgaattccttacagaa

SEQ ID NO: 1401964 - DNA, 22 bp, Artificial Sequence
  chemically synthesized
cttacagaaggctttcaatttc

SEQ ID NO: 1401965 - DNA, 22 bp, Artificial Sequence
  chemically synthesized
acagaaggctttcaatttcctt

SEQ ID NO: 1401966 - DNA, 22 bp, Artificial Sequence
  chemically synthesized
cagaaggctttcaatttccttt

SEQ ID NO: 1401967 - DNA, 22 bp, Artificial Sequence
  chemically synthesized
atggatatgagcaaaggaaatt

SEQ ID NO: 1401968 - DNA, 22 bp, Artificial Sequence
  chemically synthesized
tgatggatatgagcaaaggaaa

SEQ ID NO: 1401969 - DNA, 22 bp, Artificial Sequence
  chemically synthesized
ctgatggatatgagcaaaggaa

SEQ ID NO: 1401970 - DNA, 22 bp, Artificial Sequence
  chemically synthesized
tcaatttcctttgctcatatcc

SEQ ID NO: 1401971 - DNA, 22 bp, Artificial Sequence
  chemically synthesized
caatttcctttgctcatatcca

SEQ ID NO: 1401972 - DNA, 22 bp, Artificial Sequence
  chemically synthesized
aatttcctttgctcatatccat

SEQ ID NO: 1401973 - DNA, 22 bp, Artificial Sequence
  chemically synthesized
cctttgctcatatccatcagaa

SEQ ID NO: 1401974 - DNA, 22 bp, Artificial Sequence
  chemically synthesized
ctttgctcatatccatcagaag

SEQ ID NO: 1401975 - DNA, 22 bp, Artificial Sequence
  chemically synthesized
taaataataaatcttctgatgg

SEQ ID NO: 1401976 - DNA, 22 bp, Artificial Sequence
  chemically synthesized
tgctcatatccatcagaagatt

SEQ ID NO: 1401977 - DNA, 22 bp, Artificial Sequence
  chemically synthesized
ctgtaaataataaatcttctga

SEQ ID NO: 1401978 - DNA, 22 bp, Artificial Sequence
  chemically synthesized
gctcatatccatcagaagattt

SEQ ID NO: 1401979 - DNA, 22 bp, Artificial Sequence
  chemically synthesized
ctcatatccatcagaagattta

SEQ ID NO: 1401980 - DNA, 22 bp, Artificial Sequence
  chemically synthesized
atatccatcagaagatttatta

SEQ ID NO: 1401981 - DNA, 22 bp, Artificial Sequence
  chemically synthesized
tagctgctgtaaataataaatc

SEQ ID NO: 1401982 - DNA, 22 bp, Artificial Sequence
  chemically synthesized
gtaaggttatagctgctgtaaa

SEQ ID NO: 1401983 - DNA, 22 bp, Artificial Sequence
  chemically synthesized
agtaaggttatagctgctgtaa

SEQ ID NO: 1401984 - DNA, 22 bp, Artificial Sequence
  chemically synthesized
attatttacagcagctataacc

SEQ ID NO: 1401985 - DNA, 22 bp, Artificial Sequence
  chemically synthesized
ttatttacagcagctataacct

SEQ ID NO: 1401986 - DNA, 22 bp, Artificial Sequence
  chemically synthesized
tttacagcagctataaccttac

SEQ ID NO: 1401987 - DNA, 22 bp, Artificial Sequence
  chemically synthesized
agaaatacatttagtaaggtta

SEQ ID NO: 1401988 - DNA, 22 bp, Artificial Sequence
  chemically synthesized
aagaaatacatttagtaaggtt

SEQ ID NO: 1401989 - DNA, 22 bp, Artificial Sequence
  chemically synthesized
acagcagctataaccttactaa

SEQ ID NO: 1401990 - DNA, 22 bp, Artificial Sequence
  chemically synthesized
cagcagctataaccttactaaa

SEQ ID NO: 1401991 - DNA, 22 bp, Artificial Sequence
  chemically synthesized
tttaagaaatacatttagtaag

SEQ ID NO: 1401992 - DNA, 22 bp, Artificial Sequence
  chemically synthesized
attatttaagaaatacatttag

SEQ ID NO: 1401993 - DNA, 22 bp, Artificial Sequence
  chemically synthesized
taaccttactaaatgtatttct

SEQ ID NO: 1401994 - DNA, 22 bp, Artificial Sequence
  chemically synthesized
tgtctcattatttaagaaatac

SEQ ID NO: 1401995 - DNA, 22 bp, Artificial Sequence
  chemically synthesized
atgtctcattatttaagaaata

SEQ ID NO: 1401996 - DNA, 22 bp, Artificial Sequence
  chemically synthesized
actaaatgtatttcttaaataa

SEQ ID NO: 1401997 - DNA, 22 bp, Artificial Sequence
  chemically synthesized
ctaaatgtatttcttaaataat

SEQ ID NO: 1401998 - DNA, 22 bp, Artificial Sequence
  chemically synthesized
aacatttatgtctcattattta

SEQ ID NO: 1401999 - DNA, 22 bp, Artificial Sequence
  chemically synthesized
aatgtatttcttaaataatgag

SEQ ID NO: 1402000 - DNA, 22 bp, Artificial Sequence
  chemically synthesized
cttaaataatgagacataaatg

SEQ ID NO: 1402001 - DNA, 22 bp, Artificial Sequence
  chemically synthesized
ttaaataatgagacataaatgt

SEQ ID NO: 1402002 - DNA, 22 bp, Artificial Sequence
  chemically synthesized
aaataatgagacataaatgttg

SEQ ID NO: 1402003 - DNA, 22 bp, Artificial Sequence
  chemically synthesized
aataatgagacataaatgttga

SEQ ID NO: 1402004 - DNA, 22 bp, Artificial Sequence
  chemically synthesized
tagcccatgggtcaaagagtaa

SEQ ID NO: 1402005 - DNA, 22 bp, Artificial Sequence
  chemically synthesized
tgtagcccatgggtcaaagagt

SEQ ID NO: 1402006 - DNA, 22 bp, Artificial Sequence
  chemically synthesized
aacttactctttgacccatggg

SEQ ID NO: 1402007 - DNA, 22 bp, Artificial Sequence
  chemically synthesized
actctttgacccatgggctaca

SEQ ID NO: 1402008 - DNA, 22 bp, Artificial Sequence
  chemically synthesized
ctctttgacccatgggctacag

SEQ ID NO: 1402009 - DNA, 22 bp, Artificial Sequence
  chemically synthesized
atataacatccattctgtagcc

SEQ ID NO: 1402010 - DNA, 22 bp, Artificial Sequence
  chemically synthesized
tttgacccatgggctacagaat

SEQ ID NO: 1402011 - DNA, 22 bp, Artificial Sequence
  chemically synthesized
tgacccatgggctacagaatgg

SEQ ID NO: 1402012 - DNA, 22 bp, Artificial Sequence
  chemically synthesized
ctaatataacatccattctgta

SEQ ID NO: 1402013 - DNA, 22 bp, Artificial Sequence
  chemically synthesized
gacccatgggctacagaatgga

SEQ ID NO: 1402014 - DNA, 22 bp, Artificial Sequence
  chemically synthesized
acccatgggctacagaatggat

SEQ ID NO: 1402015 - DNA, 22 bp, Artificial Sequence
  chemically synthesized
atacctgctaatataacatcca

SEQ ID NO: 1402016 - DNA, 22 bp, Artificial Sequence
  chemically synthesized
catacctgctaatataacatcc

SEQ ID NO: 1402017 - DNA, 22 bp, Artificial Sequence
  chemically synthesized
tcatacctgctaatataacatc

SEQ ID NO: 1402018 - DNA, 22 bp, Artificial Sequence
  chemically synthesized
ttttcatacctgctaatataac

SEQ ID NO: 1402019 - DNA, 22 bp, Artificial Sequence
  chemically synthesized
cagaatggatgttatattagca

SEQ ID NO: 1402020 - DNA, 22 bp, Artificial Sequence
  chemically synthesized
atgttgttttcatacctgctaa

SEQ ID NO: 1402021 - DNA, 22 bp, Artificial Sequence
  chemically synthesized
tattagcaggtatgaaaacaac

SEQ ID NO: 1402022 - DNA, 22 bp, Artificial Sequence
  chemically synthesized
gcaggtatgaaaacaacatgag

SEQ ID NO: 1402023 - DNA, 22 bp, Artificial Sequence
  chemically synthesized
gagatgtacaaggagactcatg

SEQ ID NO: 1402024 - DNA, 22 bp, Artificial Sequence
  chemically synthesized
ggagatgtacaaggagactcat

SEQ ID NO: 1402025 - DNA, 22 bp, Artificial Sequence
  chemically synthesized
atttggagatgtacaaggagac

SEQ ID NO: 1402026 - DNA, 22 bp, Artificial Sequence
  chemically synthesized
gtcatccaagagctcatttgga

SEQ ID NO: 1402027 - DNA, 22 bp, Artificial Sequence
  chemically synthesized
cttgtacatctccaaatgagct

SEQ ID NO: 1402028 - DNA, 22 bp, Artificial Sequence
  chemically synthesized
gtacatctccaaatgagctctt

SEQ ID NO: 1402029 - DNA, 22 bp, Artificial Sequence
  chemically synthesized
tacatctccaaatgagctcttg

SEQ ID NO: 1402030 - DNA, 22 bp, Artificial Sequence
  chemically synthesized
ataatgtagctggtcatccaag

SEQ ID NO: 1402031 - DNA, 22 bp, Artificial Sequence
  chemically synthesized
caaatgagctcttggatgacca

SEQ ID NO: 1402032 - DNA, 22 bp, Artificial Sequence
  chemically synthesized
attaataatgtagctggtcatc

SEQ ID NO: 1402033 - DNA, 22 bp, Artificial Sequence
  chemically synthesized
ctcattaataatgtagctggtc

SEQ ID NO: 1402034 - DNA, 22 bp, Artificial Sequence
  chemically synthesized
ctgctcattaataatgtagctg

SEQ ID NO: 1402035 - DNA, 22 bp, Artificial Sequence
  chemically synthesized
ttggatgaccagctacattatt

SEQ ID NO: 1402036 - DNA, 22 bp, Artificial Sequence
  chemically synthesized
ggatgaccagctacattattaa

SEQ ID NO: 1402037 - DNA, 22 bp, Artificial Sequence
  chemically synthesized
gatgaccagctacattattaat

SEQ ID NO: 1402038 - DNA, 22 bp, Artificial Sequence
  chemically synthesized
aaaaatattactgctcattaat

SEQ ID NO: 1402039 - DNA, 22 bp, Artificial Sequence
  chemically synthesized
caaaaatattactgctcattaa

SEQ ID NO: 1402040 - DNA, 22 bp, Artificial Sequence
  chemically synthesized
tcaaaaatattactgctcatta

SEQ ID NO: 1402041 - DNA, 22 bp, Artificial Sequence
  chemically synthesized
ttcaaaaatattactgctcatt

SEQ ID NO: 1402042 - DNA, 22 bp, Artificial Sequence
  chemically synthesized
tttcaaaaatattactgctcat

SEQ ID NO: 1402043 - DNA, 22 bp, Artificial Sequence
  chemically synthesized
ttttcaaaaatattactgctca

SEQ ID NO: 1402044 - DNA, 22 bp, Artificial Sequence
  chemically synthesized
tttttcaaaaatattactgctc

SEQ ID NO: 1402045 - DNA, 22 bp, Artificial Sequence
  chemically synthesized
ttttttcaaaaatattactgct

SEQ ID NO: 1402046 - DNA, 22 bp, Artificial Sequence
  chemically synthesized
cattattaatgagcagtaatat

SEQ ID NO: 1402047 - DNA, 22 bp, Artificial Sequence
  chemically synthesized
tttttttcaaaaatattactgc

SEQ ID NO: 1402048 - DNA, 22 bp, Artificial Sequence
  chemically synthesized
ttaatgagcagtaatatttttg

SEQ ID NO: 1402049 - DNA, 22 bp, Artificial Sequence
  chemically synthesized
atgagcagtaatatttttgaaa

SEQ ID NO: 1402050 - DNA, 22 bp, Artificial Sequence
  chemically synthesized
agaaaaatatattttttttttc

SEQ ID NO: 1402051 - DNA, 22 bp, Artificial Sequence
  chemically synthesized
tgctcagaaaaatatatttttt

SEQ ID NO: 1402052 - DNA, 22 bp, Artificial Sequence
  chemically synthesized
gtgctcagaaaaatatattttt

SEQ ID NO: 1402053 - DNA, 22 bp, Artificial Sequence
  chemically synthesized
ttgaaaaaaaaaatatattttt

SEQ ID NO: 1402054 - DNA, 22 bp, Artificial Sequence
  chemically synthesized
tgaaaaaaaaaatatatttttc

SEQ ID NO: 1402055 - DNA, 22 bp, Artificial Sequence
  chemically synthesized
gaaaaaaaaaatatatttttct

SEQ ID NO: 1402056 - DNA, 22 bp, Artificial Sequence
  chemically synthesized
aaaaaaaaaatatatttttctg

SEQ ID NO: 1402057 - DNA, 22 bp, Artificial Sequence
  chemically synthesized
agaccttgtgctcagaaaaata

SEQ ID NO: 1402058 - DNA, 22 bp, Artificial Sequence
  chemically synthesized
agcccggggttgagaccttgtg

SEQ ID NO: 1402059 - DNA, 22 bp, Artificial Sequence
  chemically synthesized
aagcccggggttgagaccttgt

SEQ ID NO: 1402060 - DNA, 22 bp, Artificial Sequence
  chemically synthesized
taagcccggggttgagaccttg

SEQ ID NO: 1402061 - DNA, 22 bp, Artificial Sequence
  chemically synthesized
ttctgagcacaaggtctcaacc

SEQ ID NO: 1402062 - DNA, 22 bp, Artificial Sequence
  chemically synthesized
tctgagcacaaggtctcaaccc

SEQ ID NO: 1402063 - DNA, 22 bp, Artificial Sequence
  chemically synthesized
ctgagcacaaggtctcaacccc

SEQ ID NO: 1402064 - DNA, 22 bp, Artificial Sequence
  chemically synthesized
tgagcacaaggtctcaaccccg

SEQ ID NO: 1402065 - DNA, 22 bp, Artificial Sequence
  chemically synthesized
aatattttaagcccggggttga

SEQ ID NO: 1402066 - DNA, 22 bp, Artificial Sequence
  chemically synthesized
agcacaaggtctcaaccccggg

SEQ ID NO: 1402067 - DNA, 22 bp, Artificial Sequence
  chemically synthesized
ctgaatattttaagcccggggt

SEQ ID NO: 1402068 - DNA, 22 bp, Artificial Sequence
  chemically synthesized
actgaatattttaagcccgggg

SEQ ID NO: 1402069 - DNA, 22 bp, Artificial Sequence
  chemically synthesized
aaccccgggcttaaaatattca

SEQ ID NO: 1402070 - DNA, 22 bp, Artificial Sequence
  chemically synthesized
cagcatgatttactgaatattt

SEQ ID NO: 1402071 - DNA, 22 bp, Artificial Sequence
  chemically synthesized
acagcatgatttactgaatatt

SEQ ID NO: 1402072 - DNA, 22 bp, Artificial Sequence
  chemically synthesized
tttacagcatgatttactgaat

SEQ ID NO: 1402073 - DNA, 22 bp, Artificial Sequence
  chemically synthesized
aaaatattcagtaaatcatgct

SEQ ID NO: 1402074 - DNA, 22 bp, Artificial Sequence
  chemically synthesized
aaatattcagtaaatcatgctg

SEQ ID NO: 1402075 - DNA, 22 bp, Artificial Sequence
  chemically synthesized
agtaaatcatgctgtaaacaga

SEQ ID NO: 1402076 - DNA, 22 bp, Artificial Sequence
  chemically synthesized
gatgagagcacatctgtttaca

SEQ ID NO: 1402077 - DNA, 22 bp, Artificial Sequence
  chemically synthesized
taaacagatgtgctctcatcca

SEQ ID NO: 1402078 - DNA, 22 bp, Artificial Sequence
  chemically synthesized
taaaagtaacaataaagcctgg

SEQ ID NO: 1402079 - DNA, 22 bp, Artificial Sequence
  chemically synthesized
tataaaagtaacaataaagcct

SEQ ID NO: 1402080 - DNA, 22 bp, Artificial Sequence
  chemically synthesized
ctctataaaagtaacaataaag

SEQ ID NO: 1402081 - DNA, 22 bp, Artificial Sequence
  chemically synthesized
gctctataaaagtaacaataaa

SEQ ID NO: 1402082 - DNA, 22 bp, Artificial Sequence
  chemically synthesized
tgctctataaaagtaacaataa

SEQ ID NO: 1402083 - DNA, 22 bp, Artificial Sequence
  chemically synthesized
tcatccaggctttattgttact

SEQ ID NO: 1402084 - DNA, 22 bp, Artificial Sequence
  chemically synthesized
atccaggctttattgttacttt

SEQ ID NO: 1402085 - DNA, 22 bp, Artificial Sequence
  chemically synthesized
gcctttgctctataaaagtaac

SEQ ID NO: 1402086 - DNA, 22 bp, Artificial Sequence
  chemically synthesized
agcctttgctctataaaagtaa

SEQ ID NO: 1402087 - DNA, 22 bp, Artificial Sequence
  chemically synthesized
tattgttacttttatagagcaa

SEQ ID NO: 1402088 - DNA, 22 bp, Artificial Sequence
  chemically synthesized
attgttacttttatagagcaaa

SEQ ID NO: 1402089 - DNA, 22 bp, Artificial Sequence
  chemically synthesized
ttgttacttttatagagcaaag

SEQ ID NO: 1402090 - DNA, 22 bp, Artificial Sequence
  chemically synthesized
aatagacttagcctttgctcta

SEQ ID NO: 1402091 - DNA, 22 bp, Artificial Sequence
  chemically synthesized
ttacttttatagagcaaaggct

SEQ ID NO: 1402092 - DNA, 22 bp, Artificial Sequence
  chemically synthesized
tgctaaatagacttagcctttg

SEQ ID NO: 1402093 - DNA, 22 bp, Artificial Sequence
  chemically synthesized
cttttatagagcaaaggctaag

SEQ ID NO: 1402094 - DNA, 22 bp, Artificial Sequence
  chemically synthesized
ttatagagcaaaggctaagtct

SEQ ID NO: 1402095 - DNA, 22 bp, Artificial Sequence
  chemically synthesized
tatagagcaaaggctaagtcta

SEQ ID NO: 1402096 - DNA, 22 bp, Artificial Sequence
  chemically synthesized
atagagcaaaggctaagtctat

SEQ ID NO: 1402097 - DNA, 22 bp, Artificial Sequence
  chemically synthesized
tagagcaaaggctaagtctatt

SEQ ID NO: 1402098 - DNA, 22 bp, Artificial Sequence
  chemically synthesized
agaattatgctaaatagactta

SEQ ID NO: 1402099 - DNA, 22 bp, Artificial Sequence
  chemically synthesized
aagaattatgctaaatagactt

SEQ ID NO: 1402100 - DNA, 22 bp, Artificial Sequence
  chemically synthesized
gggcccttaagaattatgctaa

SEQ ID NO: 1402101 - DNA, 22 bp, Artificial Sequence
  chemically synthesized
agtctatttagcataattctta

SEQ ID NO: 1402102 - DNA, 22 bp, Artificial Sequence
  chemically synthesized
aaaatcctagggcccttaagaa

SEQ ID NO: 1402103 - DNA, 22 bp, Artificial Sequence
  chemically synthesized
tttagcataattcttaagggcc

SEQ ID NO: 1402104 - DNA, 22 bp, Artificial Sequence
  chemically synthesized
tgaaaatcctagggcccttaag

SEQ ID NO: 1402105 - DNA, 22 bp, Artificial Sequence
  chemically synthesized
agcataattcttaagggcccta

SEQ ID NO: 1402106 - DNA, 22 bp, Artificial Sequence
  chemically synthesized
gcataattcttaagggccctag

SEQ ID NO: 1402107 - DNA, 22 bp, Artificial Sequence
  chemically synthesized
ccattctgaaaatcctagggcc

SEQ ID NO: 1402108 - DNA, 22 bp, Artificial Sequence
  chemically synthesized
accattctgaaaatcctagggc

SEQ ID NO: 1402109 - DNA, 22 bp, Artificial Sequence
  chemically synthesized
atttaccattctgaaaatccta

SEQ ID NO: 1402110 - DNA, 22 bp, Artificial Sequence
  chemically synthesized
ttaagggccctaggattttcag

SEQ ID NO: 1402111 - DNA, 22 bp, Artificial Sequence
  chemically synthesized
aagggccctaggattttcagaa

SEQ ID NO: 1402112 - DNA, 22 bp, Artificial Sequence
  chemically synthesized
agggccctaggattttcagaat

SEQ ID NO: 1402113 - DNA, 22 bp, Artificial Sequence
  chemically synthesized
aagcaatgctcatttaccattc

SEQ ID NO: 1402114 - DNA, 22 bp, Artificial Sequence
  chemically synthesized
ggattttcagaatggtaaatga

SEQ ID NO: 1402115 - DNA, 22 bp, Artificial Sequence
  chemically synthesized
agttgaagcaatgctcatttac

SEQ ID NO: 1402116 - DNA, 22 bp, Artificial Sequence
  chemically synthesized
aagttgaagcaatgctcattta

SEQ ID NO: 1402117 - DNA, 22 bp, Artificial Sequence
  chemically synthesized
taagttgaagcaatgctcattt

SEQ ID NO: 1402118 - DNA, 22 bp, Artificial Sequence
  chemically synthesized
tcagaatggtaaatgagcattg

SEQ ID NO: 1402119 - DNA, 22 bp, Artificial Sequence
  chemically synthesized
cagaatggtaaatgagcattgc

SEQ ID NO: 1402120 - DNA, 22 bp, Artificial Sequence
  chemically synthesized
agaatggtaaatgagcattgct

SEQ ID NO: 1402121 - DNA, 22 bp, Artificial Sequence
  chemically synthesized
gtgactttaagttgaagcaatg

SEQ ID NO: 1402122 - DNA, 22 bp, Artificial Sequence
  chemically synthesized
atgcagctggtgactttaagtt

SEQ ID NO: 1402123 - DNA, 22 bp, Artificial Sequence
  chemically synthesized
gagtctaatgcagctggtgact

SEQ ID NO: 1402124 - DNA, 22 bp, Artificial Sequence
  chemically synthesized
cttcaacttaaagtcaccagct

SEQ ID NO: 1402125 - DNA, 22 bp, Artificial Sequence
  chemically synthesized
ctagagtctaatgcagctggtg

SEQ ID NO: 1402126 - DNA, 22 bp, Artificial Sequence
  chemically synthesized
caacttaaagtcaccagctgca

SEQ ID NO: 1402127 - DNA, 22 bp, Artificial Sequence
  chemically synthesized
gctagagtctaatgcagctggt

SEQ ID NO: 1402128 - DNA, 22 bp, Artificial Sequence
  chemically synthesized
aacttaaagtcaccagctgcat

SEQ ID NO: 1402129 - DNA, 22 bp, Artificial Sequence
  chemically synthesized
tgctagagtctaatgcagctgg

SEQ ID NO: 1402130 - DNA, 22 bp, Artificial Sequence
  chemically synthesized
ttgctagagtctaatgcagctg

SEQ ID NO: 1402131 - DNA, 22 bp, Artificial Sequence
  chemically synthesized
ttttgctagagtctaatgcagc

SEQ ID NO: 1402132 - DNA, 22 bp, Artificial Sequence
  chemically synthesized
aaagtcaccagctgcattagac

SEQ ID NO: 1402133 - DNA, 22 bp, Artificial Sequence
  chemically synthesized
aagtcaccagctgcattagact

SEQ ID NO: 1402134 - DNA, 22 bp, Artificial Sequence
  chemically synthesized
cattagactctagcaaaagaat

SEQ ID NO: 1402135 - DNA, 22 bp, Artificial Sequence
  chemically synthesized
aaaggacagggtgattcttttg

SEQ ID NO: 1402136 - DNA, 22 bp, Artificial Sequence
  chemically synthesized
caaaggacagggtgattctttt

SEQ ID NO: 1402137 - DNA, 22 bp, Artificial Sequence
  chemically synthesized
gactctagcaaaagaatcaccc

SEQ ID NO: 1402138 - DNA, 22 bp, Artificial Sequence
  chemically synthesized
aaagcttcaaaggacagggtga

SEQ ID NO: 1402139 - DNA, 22 bp, Artificial Sequence
  chemically synthesized
tagcaaaagaatcaccctgtcc

SEQ ID NO: 1402140 - DNA, 22 bp, Artificial Sequence
  chemically synthesized
caaagcttcaaaggacagggtg

SEQ ID NO: 1402141 - DNA, 22 bp, Artificial Sequence
  chemically synthesized
gcaaaagaatcaccctgtcctt

SEQ ID NO: 1402142 - DNA, 22 bp, Artificial Sequence
  chemically synthesized
gcttcaaagcttcaaaggacag

SEQ ID NO: 1402143 - DNA, 22 bp, Artificial Sequence
  chemically synthesized
tcctttgaagctttgaagccag

SEQ ID NO: 1402144 - DNA, 22 bp, Artificial Sequence
  chemically synthesized
tgaagctttgaagccaggcatt

SEQ ID NO: 1402145 - DNA, 22 bp, Artificial Sequence
  chemically synthesized
gaagctttgaagccaggcattg

SEQ ID NO: 1402146 - DNA, 22 bp, Artificial Sequence
  chemically synthesized
gaaaggagaagtcaatgcctgg

SEQ ID NO: 1402147 - DNA, 22 bp, Artificial Sequence
  chemically synthesized
aagctttgaagccaggcattga

SEQ ID NO: 1402148 - DNA, 22 bp, Artificial Sequence
  chemically synthesized
tgaagccaggcattgacttctc

SEQ ID NO: 1402149 - DNA, 22 bp, Artificial Sequence
  chemically synthesized
atagctagaaaggagaagtcaa

SEQ ID NO: 1402150 - DNA, 22 bp, Artificial Sequence
  chemically synthesized
gaagccaggcattgacttctcc

SEQ ID NO: 1402151 - DNA, 22 bp, Artificial Sequence
  chemically synthesized
catagctagaaaggagaagtca

SEQ ID NO: 1402152 - DNA, 22 bp, Artificial Sequence
  chemically synthesized
aagccaggcattgacttctcct

SEQ ID NO: 1402153 - DNA, 22 bp, Artificial Sequence
  chemically synthesized
tcatagctagaaaggagaagtc

SEQ ID NO: 1402154 - DNA, 22 bp, Artificial Sequence
  chemically synthesized
ggattttcatagctagaaagga

SEQ ID NO: 1402155 - DNA, 22 bp, Artificial Sequence
  chemically synthesized
acttctcctttctagctatgaa

SEQ ID NO: 1402156 - DNA, 22 bp, Artificial Sequence
  chemically synthesized
ctcctttctagctatgaaaatc

SEQ ID NO: 1402157 - DNA, 22 bp, Artificial Sequence
  chemically synthesized
tcctttctagctatgaaaatcc

SEQ ID NO: 1402158 - DNA, 22 bp, Artificial Sequence
  chemically synthesized
ctttctagctatgaaaatccta

SEQ ID NO: 1402159 - DNA, 22 bp, Artificial Sequence
  chemically synthesized
aagaagatgccatctaggattt

SEQ ID NO: 1402160 - DNA, 22 bp, Artificial Sequence
  chemically synthesized
tctagctatgaaaatcctagat

SEQ ID NO: 1402161 - DNA, 22 bp, Artificial Sequence
  chemically synthesized
gaagaagatgccatctaggatt

SEQ ID NO: 1402162 - DNA, 22 bp, Artificial Sequence
  chemically synthesized
ctagctatgaaaatcctagatg

SEQ ID NO: 1402163 - DNA, 22 bp, Artificial Sequence
  chemically synthesized
tagctatgaaaatcctagatgg

SEQ ID NO: 1402164 - DNA, 22 bp, Artificial Sequence
  chemically synthesized
tttgaagaagatgccatctagg

SEQ ID NO: 1402165 - DNA, 22 bp, Artificial Sequence
  chemically synthesized
gctatgaaaatcctagatggca

SEQ ID NO: 1402166 - DNA, 22 bp, Artificial Sequence
  chemically synthesized
tatttgaagaagatgccatcta

SEQ ID NO: 1402167 - DNA, 22 bp, Artificial Sequence
  chemically synthesized
ctatttgaagaagatgccatct

SEQ ID NO: 1402168 - DNA, 22 bp, Artificial Sequence
  chemically synthesized
tgaaaatcctagatggcatctt

SEQ ID NO: 1402169 - DNA, 22 bp, Artificial Sequence
  chemically synthesized
gatggcatcttcttcaaataga

SEQ ID NO: 1402170 - DNA, 22 bp, Artificial Sequence
  chemically synthesized
tgtagatgaaatagccttctat

SEQ ID NO: 1402171 - DNA, 22 bp, Artificial Sequence
  chemically synthesized
atgtagatgaaatagccttcta

SEQ ID NO: 1402172 - DNA, 22 bp, Artificial Sequence
  chemically synthesized
tatgtagatgaaatagccttct

SEQ ID NO: 1402173 - DNA, 22 bp, Artificial Sequence
  chemically synthesized
ttatgtagatgaaatagccttc

SEQ ID NO: 1402174 - DNA, 22 bp, Artificial Sequence
  chemically synthesized
tttatgtagatgaaatagcctt

SEQ ID NO: 1402175 - DNA, 22 bp, Artificial Sequence
  chemically synthesized
cttcaaatagaaggctatttca

SEQ ID NO: 1402176 - DNA, 22 bp, Artificial Sequence
  chemically synthesized
ttcaaatagaaggctatttcat

SEQ ID NO: 1402177 - DNA, 22 bp, Artificial Sequence
  chemically synthesized
caaatagaaggctatttcatct

SEQ ID NO: 1402178 - DNA, 22 bp, Artificial Sequence
  chemically synthesized
aaatagaaggctatttcatcta

SEQ ID NO: 1402179 - DNA, 22 bp, Artificial Sequence
  chemically synthesized
aatgacagattttttatgtaga

SEQ ID NO: 1402180 - DNA, 22 bp, Artificial Sequence
  chemically synthesized
tactaaatgacagattttttat

SEQ ID NO: 1402181 - DNA, 22 bp, Artificial Sequence
  chemically synthesized
tttcatctacataaaaaatctg

SEQ ID NO: 1402182 - DNA, 22 bp, Artificial Sequence
  chemically synthesized
catctacataaaaaatctgtca

SEQ ID NO: 1402183 - DNA, 22 bp, Artificial Sequence
  chemically synthesized
atctacataaaaaatctgtcat

SEQ ID NO: 1402184 - DNA, 22 bp, Artificial Sequence
  chemically synthesized
cataaaaaatctgtcatttagt

SEQ ID NO: 1402185 - DNA, 22 bp, Artificial Sequence
  chemically synthesized
ataaaagtggttatactaaatg

SEQ ID NO: 1402186 - DNA, 22 bp, Artificial Sequence
  chemically synthesized
agatcattgataaaagtggtta

SEQ ID NO: 1402187 - DNA, 22 bp, Artificial Sequence
  chemically synthesized
tcatttagtataaccactttta

SEQ ID NO: 1402188 - DNA, 22 bp, Artificial Sequence
  chemically synthesized
gctaagatcattgataaaagtg

SEQ ID NO: 1402189 - DNA, 22 bp, Artificial Sequence
  chemically synthesized
tagctaagatcattgataaaag

SEQ ID NO: 1402190 - DNA, 22 bp, Artificial Sequence
  chemically synthesized
agtataaccacttttatcaatg

SEQ ID NO: 1402191 - DNA, 22 bp, Artificial Sequence
  chemically synthesized
gtataaccacttttatcaatga

SEQ ID NO: 1402192 - DNA, 22 bp, Artificial Sequence
  chemically synthesized
tccagaagttctagctaagatc

SEQ ID NO: 1402193 - DNA, 22 bp, Artificial Sequence
  chemically synthesized
ttatcaatgatcttagctagaa

SEQ ID NO: 1402194 - DNA, 22 bp, Artificial Sequence
  chemically synthesized
tatcaatgatcttagctagaac

SEQ ID NO: 1402195 - DNA, 22 bp, Artificial Sequence
  chemically synthesized
atcaatgatcttagctagaact

SEQ ID NO: 1402196 - DNA, 22 bp, Artificial Sequence
  chemically synthesized
tcaatgatcttagctagaactt

SEQ ID NO: 1402197 - DNA, 22 bp, Artificial Sequence
  chemically synthesized
cagcaagttatccagaagttct

SEQ ID NO: 1402198 - DNA, 22 bp, Artificial Sequence
  chemically synthesized
agctagaacttctggataactt

SEQ ID NO: 1402199 - DNA, 22 bp, Artificial Sequence
  chemically synthesized
gctagaacttctggataacttg

SEQ ID NO: 1402200 - DNA, 22 bp, Artificial Sequence
  chemically synthesized
gagaagctgcagcaagttatcc

SEQ ID NO: 1402201 - DNA, 22 bp, Artificial Sequence
  chemically synthesized
gaacttctggataacttgctgc

SEQ ID NO: 1402202 - DNA, 22 bp, Artificial Sequence
  chemically synthesized
ctggataacttgctgcagcttc

SEQ ID NO: 1402203 - DNA, 22 bp, Artificial Sequence
  chemically synthesized
tggataacttgctgcagcttct

SEQ ID NO: 1402204 - DNA, 22 bp, Artificial Sequence
  chemically synthesized
gataacttgctgcagcttctcc

SEQ ID NO: 1402205 - DNA, 22 bp, Artificial Sequence
  chemically synthesized
gctgcagcttctccaactgcac

SEQ ID NO: 1402206 - DNA, 22 bp, Artificial Sequence
  chemically synthesized
ctgcagcttctccaactgcact

SEQ ID NO: 1402207 - DNA, 22 bp, Artificial Sequence
  chemically synthesized
cagcttctccaactgcacttgc

SEQ ID NO: 1402208 - DNA, 22 bp, Artificial Sequence
  chemically synthesized
ctccaactgcacttgctgcctc

SEQ ID NO: 1402209 - DNA, 22 bp, Artificial Sequence
  chemically synthesized
tccaactgcacttgctgcctca

SEQ ID NO: 1402210 - DNA, 22 bp, Artificial Sequence
  chemically synthesized
caactgcacttgctgcctcacc

SEQ ID NO: 1402211 - DNA, 22 bp, Artificial Sequence
  chemically synthesized
caaacataaaagtgcaaggtga

SEQ ID NO: 1402212 - DNA, 22 bp, Artificial Sequence
  chemically synthesized
cacttgctgcctcaccttgcac

SEQ ID NO: 1402213 - DNA, 22 bp, Artificial Sequence
  chemically synthesized
gctgcctcaccttgcactttta

SEQ ID NO: 1402214 - DNA, 22 bp, Artificial Sequence
  chemically synthesized
ctgcctcaccttgcacttttat

SEQ ID NO: 1402215 - DNA, 22 bp, Artificial Sequence
  chemically synthesized
cctcaccttgcacttttatgtt

SEQ ID NO: 1402216 - DNA, 22 bp, Artificial Sequence
  chemically synthesized
accttgcacttttatgtttgga

SEQ ID NO: 1402217 - DNA, 22 bp, Artificial Sequence
  chemically synthesized
aggaaagaagccacctccaaac

SEQ ID NO: 1402218 - DNA, 22 bp, Artificial Sequence
  chemically synthesized
aaggaaagaagccacctccaaa

SEQ ID NO: 1402219 - DNA, 22 bp, Artificial Sequence
  chemically synthesized
gcacttttatgtttggaggtgg

SEQ ID NO: 1402220 - DNA, 22 bp, Artificial Sequence
  chemically synthesized
cacttttatgtttggaggtggc

SEQ ID NO: 1402221 - DNA, 22 bp, Artificial Sequence
  chemically synthesized
ttatgtttggaggtggcttctt

SEQ ID NO: 1402222 - DNA, 22 bp, Artificial Sequence
  chemically synthesized
tatgtttggaggtggcttcttt

SEQ ID NO: 1402223 - DNA, 22 bp, Artificial Sequence
  chemically synthesized
tgaagtttaaggaaagaagcca

SEQ ID NO: 1402224 - DNA, 22 bp, Artificial Sequence
  chemically synthesized
atgtttggaggtggcttctttc

SEQ ID NO: 1402225 - DNA, 22 bp, Artificial Sequence
  chemically synthesized
atgaagtttaaggaaagaagcc

SEQ ID NO: 1402226 - DNA, 22 bp, Artificial Sequence
  chemically synthesized
tgtttggaggtggcttctttcc

SEQ ID NO: 1402227 - DNA, 22 bp, Artificial Sequence
  chemically synthesized
gtttatgaagtttaaggaaaga

SEQ ID NO: 1402228 - DNA, 22 bp, Artificial Sequence
  chemically synthesized
ggaggtggcttctttccttaaa

SEQ ID NO: 1402229 - DNA, 22 bp, Artificial Sequence
  chemically synthesized
gaggtggcttctttccttaaac

SEQ ID NO: 1402230 - DNA, 22 bp, Artificial Sequence
  chemically synthesized
gcagaagttggtttatgaagtt

SEQ ID NO: 1402231 - DNA, 22 bp, Artificial Sequence
  chemically synthesized
ctttccttaaacttcataaacc

SEQ ID NO: 1402232 - DNA, 22 bp, Artificial Sequence
  chemically synthesized
tttccttaaacttcataaacca

SEQ ID NO: 1402233 - DNA, 22 bp, Artificial Sequence
  chemically synthesized
tccttaaacttcataaaccaac

SEQ ID NO: 1402234 - DNA, 22 bp, Artificial Sequence
  chemically synthesized
ccttaaacttcataaaccaact

SEQ ID NO: 1402235 - DNA, 22 bp, Artificial Sequence
  chemically synthesized
gaagctagcagaagttggttta

SEQ ID NO: 1402236 - DNA, 22 bp, Artificial Sequence
  chemically synthesized
cttaaacttcataaaccaactt

SEQ ID NO: 1402237 - DNA, 22 bp, Artificial Sequence
  chemically synthesized
aaacttcataaaccaacttctg

SEQ ID NO: 1402238 - DNA, 22 bp, Artificial Sequence
  chemically synthesized
aacttcataaaccaacttctgc

SEQ ID NO: 1402239 - DNA, 22 bp, Artificial Sequence
  chemically synthesized
cataaaccaacttctgctagct

SEQ ID NO: 1402240 - DNA, 22 bp, Artificial Sequence
  chemically synthesized
ataaaccaacttctgctagctt

SEQ ID NO: 1402241 - DNA, 22 bp, Artificial Sequence
  chemically synthesized
cagaagaaaagttggaagctag

SEQ ID NO: 1402242 - DNA, 22 bp, Artificial Sequence
  chemically synthesized
ctgctagcttccaacttttctt

SEQ ID NO: 1402243 - DNA, 22 bp, Artificial Sequence
  chemically synthesized
tgctagcttccaacttttcttc

SEQ ID NO: 1402244 - DNA, 22 bp, Artificial Sequence
  chemically synthesized
ctagcttccaacttttcttctg

SEQ ID NO: 1402245 - DNA, 22 bp, Artificial Sequence
  chemically synthesized
gcttccaacttttcttctgcag

SEQ ID NO: 1402246 - DNA, 22 bp, Artificial Sequence
  chemically synthesized
agaggtaaggaagctgcagaag

SEQ ID NO: 1402247 - DNA, 22 bp, Artificial Sequence
  chemically synthesized
ccaacttttcttctgcagcttc

SEQ ID NO: 1402248 - DNA, 22 bp, Artificial Sequence
  chemically synthesized
caacttttcttctgcagcttcc

SEQ ID NO: 1402249 - DNA, 22 bp, Artificial Sequence
  chemically synthesized
cgaaggctgagaggtaaggaag

SEQ ID NO: 1402250 - DNA, 22 bp, Artificial Sequence
  chemically synthesized
ttcttctgcagcttccttacct

SEQ ID NO: 1402251 - DNA, 22 bp, Artificial Sequence
  chemically synthesized
tcttctgcagcttccttacctc

SEQ ID NO: 1402252 - DNA, 22 bp, Artificial Sequence
  chemically synthesized
tacgaaggctgagaggtaagga

SEQ ID NO: 1402253 - DNA, 22 bp, Artificial Sequence
  chemically synthesized
cttctgcagcttccttacctct

SEQ ID NO: 1402254 - DNA, 22 bp, Artificial Sequence
  chemically synthesized
ttctgcagcttccttacctctc

SEQ ID NO: 1402255 - DNA, 22 bp, Artificial Sequence
  chemically synthesized
ctgcagcttccttacctctcag

SEQ ID NO: 1402256 - DNA, 22 bp, Artificial Sequence
  chemically synthesized
tgcagcttccttacctctcagc

SEQ ID NO: 1402257 - DNA, 22 bp, Artificial Sequence
  chemically synthesized
aattctacgaaggctgagaggt

SEQ ID NO: 1402258 - DNA, 22 bp, Artificial Sequence
  chemically synthesized
caattctacgaaggctgagagg

SEQ ID NO: 1402259 - DNA, 22 bp, Artificial Sequence
  chemically synthesized
cagcttccttacctctcagcct

SEQ ID NO: 1402260 - DNA, 22 bp, Artificial Sequence
  chemically synthesized
ttcaattctacgaaggctgaga

SEQ ID NO: 1402261 - DNA, 22 bp, Artificial Sequence
  chemically synthesized
tcttcaattctacgaaggctga

SEQ ID NO: 1402262 - DNA, 22 bp, Artificial Sequence
  chemically synthesized
ccttacctctcagccttcgtag

SEQ ID NO: 1402263 - DNA, 22 bp, Artificial Sequence
  chemically synthesized
cttacctctcagccttcgtaga

SEQ ID NO: 1402264 - DNA, 22 bp, Artificial Sequence
  chemically synthesized
acctctcagccttcgtagaatt

SEQ ID NO: 1402265 - DNA, 22 bp, Artificial Sequence
  chemically synthesized
cctctcagccttcgtagaattg

SEQ ID NO: 1402266 - DNA, 22 bp, Artificial Sequence
  chemically synthesized
tcagccttcgtagaattgaaga

SEQ ID NO: 1402267 - DNA, 22 bp, Artificial Sequence
  chemically synthesized
agccttcgtagaattgaagaga

SEQ ID NO: 1402268 - DNA, 22 bp, Artificial Sequence
  chemically synthesized
cgtagaattgaagagagttggg

SEQ ID NO: 1402269 - DNA, 22 bp, Artificial Sequence
  chemically synthesized
gtagaattgaagagagttggga

SEQ ID NO: 1402270 - DNA, 22 bp, Artificial Sequence
  chemically synthesized
atccagaggaagatcccaactc

SEQ ID NO: 1402271 - DNA, 22 bp, Artificial Sequence
  chemically synthesized
aagagagttgggatcttcctct

SEQ ID NO: 1402272 - DNA, 22 bp, Artificial Sequence
  chemically synthesized
accaagagctaatccagaggaa

SEQ ID NO: 1402273 - DNA, 22 bp, Artificial Sequence
  chemically synthesized
aaccaagagctaatccagagga

SEQ ID NO: 1402274 - DNA, 22 bp, Artificial Sequence
  chemically synthesized
ccttaaccaagagctaatccag

SEQ ID NO: 1402275 - DNA, 22 bp, Artificial Sequence
  chemically synthesized
ggatcttcctctggattagctc

SEQ ID NO: 1402276 - DNA, 22 bp, Artificial Sequence
  chemically synthesized
cctctggattagctcttggtta

SEQ ID NO: 1402277 - DNA, 22 bp, Artificial Sequence
  chemically synthesized
ctctggattagctcttggttaa

SEQ ID NO: 1402278 - DNA, 22 bp, Artificial Sequence
  chemically synthesized
tggattagctcttggttaaggg

SEQ ID NO: 1402279 - DNA, 22 bp, Artificial Sequence
  chemically synthesized
gattagctcttggttaagggaa

SEQ ID NO: 1402280 - DNA, 22 bp, Artificial Sequence
  chemically synthesized
gctcttggttaagggaatattg

SEQ ID NO: 1402281 - DNA, 22 bp, Artificial Sequence
  chemically synthesized
ttggttaagggaatattgtggc

SEQ ID NO: 1402282 - DNA, 22 bp, Artificial Sequence
  chemically synthesized
ggttaagggaatattgtggctg

SEQ ID NO: 1402283 - DNA, 22 bp, Artificial Sequence
  chemically synthesized
gacagatcaaaccagccacaat

SEQ ID NO: 1402284 - DNA, 22 bp, Artificial Sequence
  chemically synthesized
gttaagggaatattgtggctgg

SEQ ID NO: 1402285 - DNA, 22 bp, Artificial Sequence
  chemically synthesized
agggaatattgtggctggtttg

SEQ ID NO: 1402286 - DNA, 22 bp, Artificial Sequence
  chemically synthesized
aatggtctagacagatcaaacc

SEQ ID NO: 1402287 - DNA, 22 bp, Artificial Sequence
  chemically synthesized
aaatggtctagacagatcaaac

SEQ ID NO: 1402288 - DNA, 22 bp, Artificial Sequence
  chemically synthesized
tggctggtttgatctgtctaga

SEQ ID NO: 1402289 - DNA, 22 bp, Artificial Sequence
  chemically synthesized
gtttgatctgtctagaccattt

SEQ ID NO: 1402290 - DNA, 22 bp, Artificial Sequence
  chemically synthesized
atatggataaaatttaaatggt

SEQ ID NO: 1402291 - DNA, 22 bp, Artificial Sequence
  chemically synthesized
gatctgtctagaccatttaaat

SEQ ID NO: 1402292 - DNA, 22 bp, Artificial Sequence
  chemically synthesized
atctgtctagaccatttaaatt

SEQ ID NO: 1402293 - DNA, 22 bp, Artificial Sequence
  chemically synthesized
ctgatatggataaaatttaaat

SEQ ID NO: 1402294 - DNA, 22 bp, Artificial Sequence
  chemically synthesized
ctgctgatatggataaaattta

SEQ ID NO: 1402295 - DNA, 22 bp, Artificial Sequence
  chemically synthesized
tctagaccatttaaattttatc

SEQ ID NO: 1402296 - DNA, 22 bp, Artificial Sequence
  chemically synthesized
actgctgatatggataaaattt

SEQ ID NO: 1402297 - DNA, 22 bp, Artificial Sequence
  chemically synthesized
gaccatttaaattttatccata

SEQ ID NO: 1402298 - DNA, 22 bp, Artificial Sequence
  chemically synthesized
aaattttatccatatcagcagt

SEQ ID NO: 1402299 - DNA, 22 bp, Artificial Sequence
  chemically synthesized
aattttatccatatcagcagta

SEQ ID NO: 1402300 - DNA, 22 bp, Artificial Sequence
  chemically synthesized
tatccatatcagcagtaagact

SEQ ID NO: 1402301 - DNA, 22 bp, Artificial Sequence
  chemically synthesized
atccatatcagcagtaagactg

SEQ ID NO: 1402302 - DNA, 22 bp, Artificial Sequence
  chemically synthesized
tccatatcagcagtaagactgc

SEQ ID NO: 1402303 - DNA, 22 bp, Artificial Sequence
  chemically synthesized
ctttgctttcttttcattcatg

SEQ ID NO: 1402304 - DNA, 22 bp, Artificial Sequence
  chemically synthesized
cccccatgcacacatgaatgaa

SEQ ID NO: 1402305 - DNA, 22 bp, Artificial Sequence
  chemically synthesized
tgctttcttttcattcatgtgt

SEQ ID NO: 1402306 - DNA, 22 bp, Artificial Sequence
  chemically synthesized
gctttcttttcattcatgtgtg

SEQ ID NO: 1402307 - DNA, 22 bp, Artificial Sequence
  chemically synthesized
ctttcttttcattcatgtgtgc

SEQ ID NO: 1402308 - DNA, 22 bp, Artificial Sequence
  chemically synthesized
tcttttcattcatgtgtgcatg

SEQ ID NO: 1402309 - DNA, 22 bp, Artificial Sequence
  chemically synthesized
cttttcattcatgtgtgcatgg

SEQ ID NO: 1402310 - DNA, 22 bp, Artificial Sequence
  chemically synthesized
aaagtgttacccccatgcacac

SEQ ID NO: 1402311 - DNA, 22 bp, Artificial Sequence
  chemically synthesized
ttttcattcatgtgtgcatggg

SEQ ID NO: 1402312 - DNA, 22 bp, Artificial Sequence
  chemically synthesized
ttcattcatgtgtgcatggggg

SEQ ID NO: 1402313 - DNA, 22 bp, Artificial Sequence
  chemically synthesized
tcattcatgtgtgcatgggggt

SEQ ID NO: 1402314 - DNA, 22 bp, Artificial Sequence
  chemically synthesized
cattcatgtgtgcatgggggta

SEQ ID NO: 1402315 - DNA, 22 bp, Artificial Sequence
  chemically synthesized
attcatgtgtgcatgggggtaa

SEQ ID NO: 1402316 - DNA, 22 bp, Artificial Sequence
  chemically synthesized
atgtgtgcatgggggtaacact

SEQ ID NO: 1402317 - DNA, 22 bp, Artificial Sequence
  chemically synthesized
aaggaaattaaaagtgttaccc

SEQ ID NO: 1402318 - DNA, 22 bp, Artificial Sequence
  chemically synthesized
ttgaaggaaattaaaagtgtta

SEQ ID NO: 1402319 - DNA, 22 bp, Artificial Sequence
  chemically synthesized
ttaatttccttcaataattttt

SEQ ID NO: 1402320 - DNA, 22 bp, Artificial Sequence
  chemically synthesized
taatttccttcaataatttttc

SEQ ID NO: 1402321 - DNA, 22 bp, Artificial Sequence
  chemically synthesized
aatttccttcaataatttttcc

SEQ ID NO: 1402322 - DNA, 22 bp, Artificial Sequence
  chemically synthesized
atttccttcaataatttttcct

SEQ ID NO: 1402323 - DNA, 22 bp, Artificial Sequence
  chemically synthesized
ccttcaataatttttcctttgc

SEQ ID NO: 1402324 - DNA, 22 bp, Artificial Sequence
  chemically synthesized
cttcaataatttttcctttgca

SEQ ID NO: 1402325 - DNA, 22 bp, Artificial Sequence
  chemically synthesized
gtcaaggtgtgaatgcaaagga

SEQ ID NO: 1402326 - DNA, 22 bp, Artificial Sequence
  chemically synthesized
caataatttttcctttgcattc

SEQ ID NO: 1402327 - DNA, 22 bp, Artificial Sequence
  chemically synthesized
aataatttttcctttgcattca

SEQ ID NO: 1402328 - DNA, 22 bp, Artificial Sequence
  chemically synthesized
ttcctttgcattcacaccttga

SEQ ID NO: 1402329 - DNA, 22 bp, Artificial Sequence
  chemically synthesized
tcctttgcattcacaccttgac

SEQ ID NO: 1402330 - DNA, 22 bp, Artificial Sequence
  chemically synthesized
cctttgcattcacaccttgact

SEQ ID NO: 1402331 - DNA, 22 bp, Artificial Sequence
  chemically synthesized
caccagacagttagtcaaggtg

SEQ ID NO: 1402332 - DNA, 22 bp, Artificial Sequence
  chemically synthesized
ctttgcattcacaccttgacta

SEQ ID NO: 1402333 - DNA, 22 bp, Artificial Sequence
  chemically synthesized
gcaccagacagttagtcaaggt

SEQ ID NO: 1402334 - DNA, 22 bp, Artificial Sequence
  chemically synthesized
tgcattcacaccttgactaact

SEQ ID NO: 1402335 - DNA, 22 bp, Artificial Sequence
  chemically synthesized
gcattcacaccttgactaactg

SEQ ID NO: 1402336 - DNA, 22 bp, Artificial Sequence
  chemically synthesized
cattcacaccttgactaactgt

SEQ ID NO: 1402337 - DNA, 22 bp, Artificial Sequence
  chemically synthesized
ggcgtcttgcaccagacagtta

SEQ ID NO: 1402338 - DNA, 22 bp, Artificial Sequence
  chemically synthesized
acaccttgactaactgtctggt

SEQ ID NO: 1402339 - DNA, 22 bp, Artificial Sequence
  chemically synthesized
aaatctaggcgtcttgcaccag

SEQ ID NO: 1402340 - DNA, 22 bp, Artificial Sequence
  chemically synthesized
gactaactgtctggtgcaagac

SEQ ID NO: 1402341 - DNA, 22 bp, Artificial Sequence
  chemically synthesized
actaactgtctggtgcaagacg

SEQ ID NO: 1402342 - DNA, 22 bp, Artificial Sequence
  chemically synthesized
ggctgaaatctaggcgtcttgc

SEQ ID NO: 1402343 - DNA, 22 bp, Artificial Sequence
  chemically synthesized
actgtctggtgcaagacgccta

SEQ ID NO: 1402344 - DNA, 22 bp, Artificial Sequence
  chemically synthesized
agttaggctgaaatctaggcgt

SEQ ID NO: 1402345 - DNA, 22 bp, Artificial Sequence
  chemically synthesized
tctggtgcaagacgcctagatt

SEQ ID NO: 1402346 - DNA, 22 bp, Artificial Sequence
  chemically synthesized
gtgcaagacgcctagatttcag

SEQ ID NO: 1402347 - DNA, 22 bp, Artificial Sequence
  chemically synthesized
gatttcagcctaactcagcttt

SEQ ID NO: 1402348 - DNA, 22 bp, Artificial Sequence
  chemically synthesized
cagcctaactcagcttttgaca

SEQ ID NO: 1402349 - DNA, 22 bp, Artificial Sequence
  chemically synthesized
gtgaggagggcatgtcaaaagc

SEQ ID NO: 1402350 - DNA, 22 bp, Artificial Sequence
  chemically synthesized
agcctaactcagcttttgacat

SEQ ID NO: 1402351 - DNA, 22 bp, Artificial Sequence
  chemically synthesized
agtgaggagggcatgtcaaaag

SEQ ID NO: 1402352 - DNA, 22 bp, Artificial Sequence
  chemically synthesized
tgtttagtgaggagggcatgtc

SEQ ID NO: 1402353 - DNA, 22 bp, Artificial Sequence
  chemically synthesized
actcagcttttgacatgccctc

SEQ ID NO: 1402354 - DNA, 22 bp, Artificial Sequence
  chemically synthesized
agcttttgacatgccctcctca

SEQ ID NO: 1402355 - DNA, 22 bp, Artificial Sequence
  chemically synthesized
ttgacatgccctcctcactaaa

SEQ ID NO: 1402356 - DNA, 22 bp, Artificial Sequence
  chemically synthesized
gagatgattatgtttagtgagg

SEQ ID NO: 1402357 - DNA, 22 bp, Artificial Sequence
  chemically synthesized
tgacatgccctcctcactaaac

SEQ ID NO: 1402358 - DNA, 22 bp, Artificial Sequence
  chemically synthesized
gacatgccctcctcactaaaca

SEQ ID NO: 1402359 - DNA, 22 bp, Artificial Sequence
  chemically synthesized
acatgccctcctcactaaacat

SEQ ID NO: 1402360 - DNA, 22 bp, Artificial Sequence
  chemically synthesized
aatgaaaagctagagatgatta

SEQ ID NO: 1402361 - DNA, 22 bp, Artificial Sequence
  chemically synthesized
ctcactaaacataatcatctct

SEQ ID NO: 1402362 - DNA, 22 bp, Artificial Sequence
  chemically synthesized
aaatgaaaagctagagatgatt

SEQ ID NO: 1402363 - DNA, 22 bp, Artificial Sequence
  chemically synthesized
actaaacataatcatctctagc

SEQ ID NO: 1402364 - DNA, 22 bp, Artificial Sequence
  chemically synthesized
atcttaaatgaaaagctagaga

SEQ ID NO: 1402365 - DNA, 22 bp, Artificial Sequence
  chemically synthesized
aacataatcatctctagctttt

SEQ ID NO: 1402366 - DNA, 22 bp, Artificial Sequence
  chemically synthesized
acatgtctcatcttaaatgaaa

SEQ ID NO: 1402367 - DNA, 22 bp, Artificial Sequence
  chemically synthesized
tagcttttcatttaagatgaga

SEQ ID NO: 1402368 - DNA, 22 bp, Artificial Sequence
  chemically synthesized
gcttttcatttaagatgagaca

SEQ ID NO: 1402369 - DNA, 22 bp, Artificial Sequence
  chemically synthesized
ttcatttaagatgagacatgtg

SEQ ID NO: 1402370 - DNA, 22 bp, Artificial Sequence
  chemically synthesized
tcatttaagatgagacatgtga

SEQ ID NO: 1402371 - DNA, 22 bp, Artificial Sequence
  chemically synthesized
catttaagatgagacatgtgag

SEQ ID NO: 1402372 - DNA, 22 bp, Artificial Sequence
  chemically synthesized
atttaagatgagacatgtgaga

SEQ ID NO: 1402373 - DNA, 22 bp, Artificial Sequence
  chemically synthesized
aagtgaaaggaagagtctcaca

SEQ ID NO: 1402374 - DNA, 22 bp, Artificial Sequence
  chemically synthesized
aagatgagacatgtgagactct

SEQ ID NO: 1402375 - DNA, 22 bp, Artificial Sequence
  chemically synthesized
agatgagacatgtgagactctt

SEQ ID NO: 1402376 - DNA, 22 bp, Artificial Sequence
  chemically synthesized
agtgttcaagtgaaaggaagag

SEQ ID NO: 1402377 - DNA, 22 bp, Artificial Sequence
  chemically synthesized
taagtgttcaagtgaaaggaag

SEQ ID NO: 1402378 - DNA, 22 bp, Artificial Sequence
  chemically synthesized
ttcctttcacttgaacacttag

SEQ ID NO: 1402379 - DNA, 22 bp, Artificial Sequence
  chemically synthesized
cctttcacttgaacacttagag

SEQ ID NO: 1402380 - DNA, 22 bp, Artificial Sequence
  chemically synthesized
ctttcacttgaacacttagaga

SEQ ID NO: 1402381 - DNA, 22 bp, Artificial Sequence
  chemically synthesized
tcacttgaacacttagagacca

SEQ ID NO: 1402382 - DNA, 22 bp, Artificial Sequence
  chemically synthesized
acaaccccacagtggtctctaa

SEQ ID NO: 1402383 - DNA, 22 bp, Artificial Sequence
  chemically synthesized
cacttgaacacttagagaccac

SEQ ID NO: 1402384 - DNA, 22 bp, Artificial Sequence
  chemically synthesized
acttgaacacttagagaccact

SEQ ID NO: 1402385 - DNA, 22 bp, Artificial Sequence
  chemically synthesized
gaacacttagagaccactgtgg

SEQ ID NO: 1402386 - DNA, 22 bp, Artificial Sequence
  chemically synthesized
aacacttagagaccactgtggg

SEQ ID NO: 1402387 - DNA, 22 bp, Artificial Sequence
  chemically synthesized
agagaccactgtggggttgtta

SEQ ID NO: 1402388 - DNA, 22 bp, Artificial Sequence
  chemically synthesized
gagaccactgtggggttgttaa

SEQ ID NO: 1402389 - DNA, 22 bp, Artificial Sequence
  chemically synthesized
aaatgaagccagttaacaaccc

SEQ ID NO: 1402390 - DNA, 22 bp, Artificial Sequence
  chemically synthesized
tggggttgttaactggcttcat

SEQ ID NO: 1402391 - DNA, 22 bp, Artificial Sequence
  chemically synthesized
agacaaaccaatattgaaatga

SEQ ID NO: 1402392 - DNA, 22 bp, Artificial Sequence
  chemically synthesized
ttaactggcttcatttcaatat

SEQ ID NO: 1402393 - DNA, 22 bp, Artificial Sequence
  chemically synthesized
tgagacaaaccaatattgaaat

SEQ ID NO: 1402394 - DNA, 22 bp, Artificial Sequence
  chemically synthesized
actggcttcatttcaatattgg

SEQ ID NO: 1402395 - DNA, 22 bp, Artificial Sequence
  chemically synthesized
ttctgagacaaaccaatattga

SEQ ID NO: 1402396 - DNA, 22 bp, Artificial Sequence
  chemically synthesized
tattctgagacaaaccaatatt

SEQ ID NO: 1402397 - DNA, 22 bp, Artificial Sequence
  chemically synthesized
ctattctgagacaaaccaatat

SEQ ID NO: 1402398 - DNA, 22 bp, Artificial Sequence
  chemically synthesized
gcttcatttcaatattggtttg

SEQ ID NO: 1402399 - DNA, 22 bp, Artificial Sequence
  chemically synthesized
tctattctgagacaaaccaata

SEQ ID NO: 1402400 - DNA, 22 bp, Artificial Sequence
  chemically synthesized
catttcaatattggtttgtctc

SEQ ID NO: 1402401 - DNA, 22 bp, Artificial Sequence
  chemically synthesized
atttcaatattggtttgtctca

SEQ ID NO: 1402402 - DNA, 22 bp, Artificial Sequence
  chemically synthesized
gacctttctattctgagacaaa

SEQ ID NO: 1402403 - DNA, 22 bp, Artificial Sequence
  chemically synthesized
ggacctttctattctgagacaa

SEQ ID NO: 1402404 - DNA, 22 bp, Artificial Sequence
  chemically synthesized
caatattggtttgtctcagaat

SEQ ID NO: 1402405 - DNA, 22 bp, Artificial Sequence
  chemically synthesized
aatattggtttgtctcagaata

SEQ ID NO: 1402406 - DNA, 22 bp, Artificial Sequence
  chemically synthesized
cttggacctttctattctgaga

SEQ ID NO: 1402407 - DNA, 22 bp, Artificial Sequence
  chemically synthesized
tccttggacctttctattctga

SEQ ID NO: 1402408 - DNA, 22 bp, Artificial Sequence
  chemically synthesized
cctctccttggacctttctatt

SEQ ID NO: 1402409 - DNA, 22 bp, Artificial Sequence
  chemically synthesized
gtttgtctcagaatagaaaggt

SEQ ID NO: 1402410 - DNA, 22 bp, Artificial Sequence
  chemically synthesized
tctccctctccttggacctttc

SEQ ID NO: 1402411 - DNA, 22 bp, Artificial Sequence
  chemically synthesized
gtctcagaatagaaaggtccaa

SEQ ID NO: 1402412 - DNA, 22 bp, Artificial Sequence
  chemically synthesized
tctcagaatagaaaggtccaag

SEQ ID NO: 1402413 - DNA, 22 bp, Artificial Sequence
  chemically synthesized
agaatagaaaggtccaaggaga

SEQ ID NO: 1402414 - DNA, 22 bp, Artificial Sequence
  chemically synthesized
ccaaccggccacccccaccccc

SEQ ID NO: 1402415 - DNA, 22 bp, Artificial Sequence
  chemically synthesized
taccaaccggccacccccaccc

SEQ ID NO: 1402416 - DNA, 22 bp, Artificial Sequence
  chemically synthesized
agtgctctaccaaccggccacc

SEQ ID NO: 1402417 - DNA, 22 bp, Artificial Sequence
  chemically synthesized
tgagtgctctaccaaccggcca

SEQ ID NO: 1402418 - DNA, 22 bp, Artificial Sequence
  chemically synthesized
tgtgtgttctgagtgctctacc

SEQ ID NO: 1402419 - DNA, 22 bp, Artificial Sequence
  chemically synthesized
atcaatgttgtgtgtgttctga

SEQ ID NO: 1402420 - DNA, 22 bp, Artificial Sequence
  chemically synthesized
aatcaatgttgtgtgtgttctg

SEQ ID NO: 1402421 - DNA, 22 bp, Artificial Sequence
  chemically synthesized
gtagagcactcagaacacacac

SEQ ID NO: 1402422 - DNA, 22 bp, Artificial Sequence
  chemically synthesized
agaacacacacaacattgatta

SEQ ID NO: 1402423 - DNA, 22 bp, Artificial Sequence
  chemically synthesized
attaagtttgttatttcatatg

SEQ ID NO: 1402424 - DNA, 22 bp, Artificial Sequence
  chemically synthesized
agtttgttatttcatatgggca

SEQ ID NO: 1402425 - DNA, 22 bp, Artificial Sequence
  chemically synthesized
ggggcaacatgagtcatgccca

SEQ ID NO: 1402426 - DNA, 22 bp, Artificial Sequence
  chemically synthesized
gttatttcatatgggcatgact

SEQ ID NO: 1402427 - DNA, 22 bp, Artificial Sequence
  chemically synthesized
gggggcaacatgagtcatgccc

SEQ ID NO: 1402428 - DNA, 22 bp, Artificial Sequence
  chemically synthesized
ttatttcatatgggcatgactc

SEQ ID NO: 1402429 - DNA, 22 bp, Artificial Sequence
  chemically synthesized
tgggggcaacatgagtcatgcc

SEQ ID NO: 1402430 - DNA, 22 bp, Artificial Sequence
  chemically synthesized
ttgggggcaacatgagtcatgc

SEQ ID NO: 1402431 - DNA, 22 bp, Artificial Sequence
  chemically synthesized
tttcatatgggcatgactcatg

SEQ ID NO: 1402432 - DNA, 22 bp, Artificial Sequence
  chemically synthesized
catatgggcatgactcatgttg

SEQ ID NO: 1402433 - DNA, 22 bp, Artificial Sequence
  chemically synthesized
atatgggcatgactcatgttgc

SEQ ID NO: 1402434 - DNA, 22 bp, Artificial Sequence
  chemically synthesized
tcatttttgggggcaacatgag

SEQ ID NO: 1402435 - DNA, 22 bp, Artificial Sequence
  chemically synthesized
ttgtcatttttgggggcaacat

SEQ ID NO: 1402436 - DNA, 22 bp, Artificial Sequence
  chemically synthesized
ctattgtcatttttgggggcaa

SEQ ID NO: 1402437 - DNA, 22 bp, Artificial Sequence
  chemically synthesized
aagttactattgtcatttttgg

SEQ ID NO: 1402438 - DNA, 22 bp, Artificial Sequence
  chemically synthesized
gaagttactattgtcatttttg

SEQ ID NO: 1402439 - DNA, 22 bp, Artificial Sequence
  chemically synthesized
tgaagttactattgtcattttt

SEQ ID NO: 1402440 - DNA, 22 bp, Artificial Sequence
  chemically synthesized
atgttgcccccaaaaatgacaa

SEQ ID NO: 1402441 - DNA, 22 bp, Artificial Sequence
  chemically synthesized
cccccaaaaatgacaatagtaa

SEQ ID NO: 1402442 - DNA, 22 bp, Artificial Sequence
  chemically synthesized
tgatcaatgatctttgaagtta

SEQ ID NO: 1402443 - DNA, 22 bp, Artificial Sequence
  chemically synthesized
tgatctatgatcaatgatcttt

SEQ ID NO: 1402444 - DNA, 22 bp, Artificial Sequence
  chemically synthesized
caaagatcattgatcatagatc

SEQ ID NO: 1402445 - DNA, 22 bp, Artificial Sequence
  chemically synthesized
aaagatcattgatcatagatca

SEQ ID NO: 1402446 - DNA, 22 bp, Artificial Sequence
  chemically synthesized
aaagaatatatggagatctatg

SEQ ID NO: 1402447 - DNA, 22 bp, Artificial Sequence
  chemically synthesized
atcatagatcatagatctccat

SEQ ID NO: 1402448 - DNA, 22 bp, Artificial Sequence
  chemically synthesized
gagtacaaaagccacactgaaa

SEQ ID NO: 1402449 - DNA, 22 bp, Artificial Sequence
  chemically synthesized
catatattctttcagtgtggct

SEQ ID NO: 1402450 - DNA, 22 bp, Artificial Sequence
  chemically synthesized
gttagagtacaaaagccacact

SEQ ID NO: 1402451 - DNA, 22 bp, Artificial Sequence
  chemically synthesized
acactggttagagtacaaaagc

SEQ ID NO: 1402452 - DNA, 22 bp, Artificial Sequence
  chemically synthesized
tttcagtgtggcttttgtactc

SEQ ID NO: 1402453 - DNA, 22 bp, Artificial Sequence
  chemically synthesized
tcagtgtggcttttgtactcta

SEQ ID NO: 1402454 - DNA, 22 bp, Artificial Sequence
  chemically synthesized
cagtgtggcttttgtactctaa

SEQ ID NO: 1402455 - DNA, 22 bp, Artificial Sequence
  chemically synthesized
agtgtggcttttgtactctaac

SEQ ID NO: 1402456 - DNA, 22 bp, Artificial Sequence
  chemically synthesized
aacaagctgacactggttagag

SEQ ID NO: 1402457 - DNA, 22 bp, Artificial Sequence
  chemically synthesized
ccctcaacaagctgacactggt

SEQ ID NO: 1402458 - DNA, 22 bp, Artificial Sequence
  chemically synthesized
ttgtactctaaccagtgtcagc

SEQ ID NO: 1402459 - DNA, 22 bp, Artificial Sequence
  chemically synthesized
tgccctcaacaagctgacactg

SEQ ID NO: 1402460 - DNA, 22 bp, Artificial Sequence
  chemically synthesized
tgtactctaaccagtgtcagct

SEQ ID NO: 1402461 - DNA, 22 bp, Artificial Sequence
  chemically synthesized
ctgccctcaacaagctgacact

SEQ ID NO: 1402462 - DNA, 22 bp, Artificial Sequence
  chemically synthesized
gtactctaaccagtgtcagctt

SEQ ID NO: 1402463 - DNA, 22 bp, Artificial Sequence
  chemically synthesized
tactctaaccagtgtcagcttg

SEQ ID NO: 1402464 - DNA, 22 bp, Artificial Sequence
  chemically synthesized
taaccagtgtcagcttgttgag

SEQ ID NO: 1402465 - DNA, 22 bp, Artificial Sequence
  chemically synthesized
accagtgtcagcttgttgaggg

SEQ ID NO: 1402466 - DNA, 22 bp, Artificial Sequence
  chemically synthesized
atcagaaatgatttctgccctc

SEQ ID NO: 1402467 - DNA, 22 bp, Artificial Sequence
  chemically synthesized
gttgagggcagaaatcatttct

SEQ ID NO: 1402468 - DNA, 22 bp, Artificial Sequence
  chemically synthesized
ttgagggcagaaatcatttctg

SEQ ID NO: 1402469 - DNA, 22 bp, Artificial Sequence
  chemically synthesized
agggcagaaatcatttctgatt

SEQ ID NO: 1402470 - DNA, 22 bp, Artificial Sequence
  chemically synthesized
aaagcatagaaagattaatcag

SEQ ID NO: 1402471 - DNA, 22 bp, Artificial Sequence
  chemically synthesized
gtaacactgaaagcatagaaag

SEQ ID NO: 1402472 - DNA, 22 bp, Artificial Sequence
  chemically synthesized
agtaacactgaaagcatagaaa

SEQ ID NO: 1402473 - DNA, 22 bp, Artificial Sequence
  chemically synthesized
ctgattaatctttctatgcttt

SEQ ID NO: 1402474 - DNA, 22 bp, Artificial Sequence
  chemically synthesized
tgattaatctttctatgctttc

SEQ ID NO: 1402475 - DNA, 22 bp, Artificial Sequence
  chemically synthesized
acttagtaacactgaaagcata

SEQ ID NO: 1402476 - DNA, 22 bp, Artificial Sequence
  chemically synthesized
attaatctttctatgctttcag

SEQ ID NO: 1402477 - DNA, 22 bp, Artificial Sequence
  chemically synthesized
atctttctatgctttcagtgtt

SEQ ID NO: 1402478 - DNA, 22 bp, Artificial Sequence
  chemically synthesized
tctatgctttcagtgttactaa

SEQ ID NO: 1402479 - DNA, 22 bp, Artificial Sequence
  chemically synthesized
ctatgctttcagtgttactaag

SEQ ID NO: 1402480 - DNA, 22 bp, Artificial Sequence
  chemically synthesized
aaatatcattcacttagtaaca

SEQ ID NO: 1402481 - DNA, 22 bp, Artificial Sequence
  chemically synthesized
tatgctttcagtgttactaagt

SEQ ID NO: 1402482 - DNA, 22 bp, Artificial Sequence
  chemically synthesized
tgctttcagtgttactaagtga

SEQ ID NO: 1402483 - DNA, 22 bp, Artificial Sequence
  chemically synthesized
cagttcaaatatcattcactta

SEQ ID NO: 1402484 - DNA, 22 bp, Artificial Sequence
  chemically synthesized
gcagttcaaatatcattcactt

SEQ ID NO: 1402485 - DNA, 22 bp, Artificial Sequence
  chemically synthesized
tcagtgttactaagtgaatgat

SEQ ID NO: 1402486 - DNA, 22 bp, Artificial Sequence
  chemically synthesized
tgcagttcaaatatcattcact

SEQ ID NO: 1402487 - DNA, 22 bp, Artificial Sequence
  chemically synthesized
cagtgttactaagtgaatgata

SEQ ID NO: 1402488 - DNA, 22 bp, Artificial Sequence
  chemically synthesized
ttgcagttcaaatatcattcac

SEQ ID NO: 1402489 - DNA, 22 bp, Artificial Sequence
  chemically synthesized
agtgttactaagtgaatgatat

SEQ ID NO: 1402490 - DNA, 22 bp, Artificial Sequence
  chemically synthesized
ctaagtgaatgatatttgaact

SEQ ID NO: 1402491 - DNA, 22 bp, Artificial Sequence
  chemically synthesized
atcacatttttgcagttcaaat

SEQ ID NO: 1402492 - DNA, 22 bp, Artificial Sequence
  chemically synthesized
catcacatttttgcagttcaaa

SEQ ID NO: 1402493 - DNA, 22 bp, Artificial Sequence
  chemically synthesized
agtgaatgatatttgaactgca

SEQ ID NO: 1402494 - DNA, 22 bp, Artificial Sequence
  chemically synthesized
acatttcatcacatttttgcag

SEQ ID NO: 1402495 - DNA, 22 bp, Artificial Sequence
  chemically synthesized
cacatttcatcacatttttgca

SEQ ID NO: 1402496 - DNA, 22 bp, Artificial Sequence
  chemically synthesized
gaactgcaaaaatgtgatgaaa

SEQ ID NO: 1402497 - DNA, 22 bp, Artificial Sequence
  chemically synthesized
aactgcaaaaatgtgatgaaat

SEQ ID NO: 1402498 - DNA, 22 bp, Artificial Sequence
  chemically synthesized
tcatatcttcacatttcatcac

SEQ ID NO: 1402499 - DNA, 22 bp, Artificial Sequence
  chemically synthesized
actgtcatatcttcacatttca

SEQ ID NO: 1402500 - DNA, 22 bp, Artificial Sequence
  chemically synthesized
caaaaatgtgatgaaatgtgaa

SEQ ID NO: 1402501 - DNA, 22 bp, Artificial Sequence
  chemically synthesized
actcactgtcatatcttcacat

SEQ ID NO: 1402502 - DNA, 22 bp, Artificial Sequence
  chemically synthesized
gactcactgtcatatcttcaca

SEQ ID NO: 1402503 - DNA, 22 bp, Artificial Sequence
  chemically synthesized
ttgactcactgtcatatcttca

SEQ ID NO: 1402504 - DNA, 22 bp, Artificial Sequence
  chemically synthesized
cttgactcactgtcatatcttc

SEQ ID NO: 1402505 - DNA, 22 bp, Artificial Sequence
  chemically synthesized
tcttgactcactgtcatatctt

SEQ ID NO: 1402506 - DNA, 22 bp, Artificial Sequence
  chemically synthesized
tttcttgactcactgtcatatc

SEQ ID NO: 1402507 - DNA, 22 bp, Artificial Sequence
  chemically synthesized
ctttcttgactcactgtcatat

SEQ ID NO: 1402508 - DNA, 22 bp, Artificial Sequence
  chemically synthesized
atgaataaagcccagaggtatc

SEQ ID NO: 1402509 - DNA, 22 bp, Artificial Sequence
  chemically synthesized
catgaataaagcccagaggtat

SEQ ID NO: 1402510 - DNA, 22 bp, Artificial Sequence
  chemically synthesized
tttcatgaataaagcccagagg

SEQ ID NO: 1402511 - DNA, 22 bp, Artificial Sequence
  chemically synthesized
ctgtttcatgaataaagcccag

SEQ ID NO: 1402512 - DNA, 22 bp, Artificial Sequence
  chemically synthesized
tgctgtttcatgaataaagccc

SEQ ID NO: 1402513 - DNA, 22 bp, Artificial Sequence
  chemically synthesized
tatctctgctgtttcatgaata

SEQ ID NO: 1402514 - DNA, 22 bp, Artificial Sequence
  chemically synthesized
atatctctgctgtttcatgaat

SEQ ID NO: 1402515 - DNA, 22 bp, Artificial Sequence
  chemically synthesized
tttatatctctgctgtttcatg

SEQ ID NO: 1402516 - DNA, 22 bp, Artificial Sequence
  chemically synthesized
tgggctttattcatgaaacagc

SEQ ID NO: 1402517 - DNA, 22 bp, Artificial Sequence
  chemically synthesized
ggctttattcatgaaacagcag

SEQ ID NO: 1402518 - DNA, 22 bp, Artificial Sequence
  chemically synthesized
aagctatttatatctctgctgt

SEQ ID NO: 1402519 - DNA, 22 bp, Artificial Sequence
  chemically synthesized
tattcatgaaacagcagagata

SEQ ID NO: 1402520 - DNA, 22 bp, Artificial Sequence
  chemically synthesized
attcatgaaacagcagagatat

SEQ ID NO: 1402521 - DNA, 22 bp, Artificial Sequence
  chemically synthesized
ttcatgaaacagcagagatata

SEQ ID NO: 1402522 - DNA, 22 bp, Artificial Sequence
  chemically synthesized
atgaaacagcagagatataaat

SEQ ID NO: 1402523 - DNA, 22 bp, Artificial Sequence
  chemically synthesized
tatgttaaagctatttatatct

SEQ ID NO: 1402524 - DNA, 22 bp, Artificial Sequence
  chemically synthesized
atatgttaaagctatttatatc

SEQ ID NO: 1402525 - DNA, 22 bp, Artificial Sequence
  chemically synthesized
aaccaatttatatgttaaagct

SEQ ID NO: 1402526 - DNA, 22 bp, Artificial Sequence
  chemically synthesized
caaccaatttatatgttaaagc

SEQ ID NO: 1402527 - DNA, 22 bp, Artificial Sequence
  chemically synthesized
tcaaccaatttatatgttaaag

SEQ ID NO: 1402528 - DNA, 22 bp, Artificial Sequence
  chemically synthesized
ctttcaaccaatttatatgtta

SEQ ID NO: 1402529 - DNA, 22 bp, Artificial Sequence
  chemically synthesized
actttcaaccaatttatatgtt

SEQ ID NO: 1402530 - DNA, 22 bp, Artificial Sequence
  chemically synthesized
acttactttcaaccaatttata

SEQ ID NO: 1402531 - DNA, 22 bp, Artificial Sequence
  chemically synthesized
aacttactttcaaccaatttat

SEQ ID NO: 1402532 - DNA, 22 bp, Artificial Sequence
  chemically synthesized
taacttactttcaaccaattta

SEQ ID NO: 1402533 - DNA, 22 bp, Artificial Sequence
  chemically synthesized
ctttaacttactttcaaccaat

SEQ ID NO: 1402534 - DNA, 22 bp, Artificial Sequence
  chemically synthesized
gctttaacttactttcaaccaa

SEQ ID NO: 1402535 - DNA, 22 bp, Artificial Sequence
  chemically synthesized
taacatataaattggttgaaag

SEQ ID NO: 1402536 - DNA, 22 bp, Artificial Sequence
  chemically synthesized
tgctttaacttactttcaacca

SEQ ID NO: 1402537 - DNA, 22 bp, Artificial Sequence
  chemically synthesized
aacatataaattggttgaaagt

SEQ ID NO: 1402538 - DNA, 22 bp, Artificial Sequence
  chemically synthesized
acatataaattggttgaaagta

SEQ ID NO: 1402539 - DNA, 22 bp, Artificial Sequence
  chemically synthesized
gcatagggattttgctttaact

SEQ ID NO: 1402540 - DNA, 22 bp, Artificial Sequence
  chemically synthesized
agcatagggattttgctttaac

SEQ ID NO: 1402541 - DNA, 22 bp, Artificial Sequence
  chemically synthesized
gttgaaagtaagttaaagcaaa

SEQ ID NO: 1402542 - DNA, 22 bp, Artificial Sequence
  chemically synthesized
tagcatagggattttgctttaa

SEQ ID NO: 1402543 - DNA, 22 bp, Artificial Sequence
  chemically synthesized
tttagcatagggattttgcttt

SEQ ID NO: 1402544 - DNA, 22 bp, Artificial Sequence
  chemically synthesized
aaagtaagttaaagcaaaatcc

SEQ ID NO: 1402545 - DNA, 22 bp, Artificial Sequence
  chemically synthesized
taactctttagcatagggattt

SEQ ID NO: 1402546 - DNA, 22 bp, Artificial Sequence
  chemically synthesized
aagcaaaatccctatgctaaag

SEQ ID NO: 1402547 - DNA, 22 bp, Artificial Sequence
  chemically synthesized
catcacaatagacagtattata

SEQ ID NO: 1402548 - DNA, 22 bp, Artificial Sequence
  chemically synthesized
tgctaaagagttataatactgt

SEQ ID NO: 1402549 - DNA, 22 bp, Artificial Sequence
  chemically synthesized
acatcacaatagacagtattat

SEQ ID NO: 1402550 - DNA, 22 bp, Artificial Sequence
  chemically synthesized
aagagttataatactgtctatt

SEQ ID NO: 1402551 - DNA, 22 bp, Artificial Sequence
  chemically synthesized
tcatatttacatcacaatagac

SEQ ID NO: 1402552 - DNA, 22 bp, Artificial Sequence
  chemically synthesized
taatactgtctattgtgatgta

SEQ ID NO: 1402553 - DNA, 22 bp, Artificial Sequence
  chemically synthesized
aactatcatatttacatcacaa

SEQ ID NO: 1402554 - DNA, 22 bp, Artificial Sequence
  chemically synthesized
tgaattcaactatcatatttac

SEQ ID NO: 1402555 - DNA, 22 bp, Artificial Sequence
  chemically synthesized
tctattgtgatgtaaatatgat

SEQ ID NO: 1402556 - DNA, 22 bp, Artificial Sequence
  chemically synthesized
atgaattcaactatcatattta

SEQ ID NO: 1402557 - DNA, 22 bp, Artificial Sequence
  chemically synthesized
ttatgaattcaactatcatatt

SEQ ID NO: 1402558 - DNA, 22 bp, Artificial Sequence
  chemically synthesized
cttatgaattcaactatcatat

SEQ ID NO: 1402559 - DNA, 22 bp, Artificial Sequence
  chemically synthesized
ttgtgatgtaaatatgatagtt

SEQ ID NO: 1402560 - DNA, 22 bp, Artificial Sequence
  chemically synthesized
tgatgtaaatatgatagttgaa

SEQ ID NO: 1402561 - DNA, 22 bp, Artificial Sequence
  chemically synthesized
aaaaatttcttatgaattcaac

SEQ ID NO: 1402562 - DNA, 22 bp, Artificial Sequence
  chemically synthesized
ccattgaaaaatttcttatgaa

SEQ ID NO: 1402563 - DNA, 22 bp, Artificial Sequence
  chemically synthesized
gccattgaaaaatttcttatga

SEQ ID NO: 1402564 - DNA, 22 bp, Artificial Sequence
  chemically synthesized
tgccattgaaaaatttcttatg

SEQ ID NO: 1402565 - DNA, 22 bp, Artificial Sequence
  chemically synthesized
attttgccattgaaaaatttct

SEQ ID NO: 1402566 - DNA, 22 bp, Artificial Sequence
  chemically synthesized
aattcataagaaatttttcaat

SEQ ID NO: 1402567 - DNA, 22 bp, Artificial Sequence
  chemically synthesized
ataagaaatttttcaatggcaa

SEQ ID NO: 1402568 - DNA, 22 bp, Artificial Sequence
  chemically synthesized
atcaccaagcctcattttgcca

SEQ ID NO: 1402569 - DNA, 22 bp, Artificial Sequence
  chemically synthesized
ttcaatggcaaaatgaggcttg

SEQ ID NO: 1402570 - DNA, 22 bp, Artificial Sequence
  chemically synthesized
tcaatggcaaaatgaggcttgg

SEQ ID NO: 1402571 - DNA, 22 bp, Artificial Sequence
  chemically synthesized
caatggcaaaatgaggcttggt

SEQ ID NO: 1402572 - DNA, 22 bp, Artificial Sequence
  chemically synthesized
aatggcaaaatgaggcttggtg

SEQ ID NO: 1402573 - DNA, 22 bp, Artificial Sequence
  chemically synthesized
gagatgataatctcatcaccaa

SEQ ID NO: 1402574 - DNA, 22 bp, Artificial Sequence
  chemically synthesized
agagatgataatctcatcacca

SEQ ID NO: 1402575 - DNA, 22 bp, Artificial Sequence
  chemically synthesized
ttagagatgataatctcatcac

SEQ ID NO: 1402576 - DNA, 22 bp, Artificial Sequence
  chemically synthesized
cttagagatgataatctcatca

SEQ ID NO: 1402577 - DNA, 22 bp, Artificial Sequence
  chemically synthesized
tcttagagatgataatctcatc

SEQ ID NO: 1402578 - DNA, 22 bp, Artificial Sequence
  chemically synthesized
aattttcttagagatgataatc

SEQ ID NO: 1402579 - DNA, 22 bp, Artificial Sequence
  chemically synthesized
ggtgatgagattatcatctcta

SEQ ID NO: 1402580 - DNA, 22 bp, Artificial Sequence
  chemically synthesized
gtgatgagattatcatctctaa

SEQ ID NO: 1402581 - DNA, 22 bp, Artificial Sequence
  chemically synthesized
agactgaattttcttagagatg

SEQ ID NO: 1402582 - DNA, 22 bp, Artificial Sequence
  chemically synthesized
aagactgaattttcttagagat

SEQ ID NO: 1402583 - DNA, 22 bp, Artificial Sequence
  chemically synthesized
tcatctctaagaaaattcagtc

SEQ ID NO: 1402584 - DNA, 22 bp, Artificial Sequence
  chemically synthesized
taagaaaattcagtcttaagta

SEQ ID NO: 1402585 - DNA, 22 bp, Artificial Sequence
  chemically synthesized
agaaaattcagtcttaagtatt

SEQ ID NO: 1402586 - DNA, 22 bp, Artificial Sequence
  chemically synthesized
agtcttaagtattactttatgt

SEQ ID NO: 1402587 - DNA, 22 bp, Artificial Sequence
  chemically synthesized
agggagaataaaaacgacataa

SEQ ID NO: 1402588 - DNA, 22 bp, Artificial Sequence
  chemically synthesized
cagggagaataaaaacgacata

SEQ ID NO: 1402589 - DNA, 22 bp, Artificial Sequence
  chemically synthesized
aagtattactttatgtcgtttt

SEQ ID NO: 1402590 - DNA, 22 bp, Artificial Sequence
  chemically synthesized
tcagggagaataaaaacgacat

SEQ ID NO: 1402591 - DNA, 22 bp, Artificial Sequence
  chemically synthesized
agtattactttatgtcgttttt

SEQ ID NO: 1402592 - DNA, 22 bp, Artificial Sequence
  chemically synthesized
ctttatgtcgtttttattctcc

SEQ ID NO: 1402593 - DNA, 22 bp, Artificial Sequence
  chemically synthesized
aggccactttcagggagaataa

SEQ ID NO: 1402594 - DNA, 22 bp, Artificial Sequence
  chemically synthesized
gaggccactttcagggagaata

SEQ ID NO: 1402595 - DNA, 22 bp, Artificial Sequence
  chemically synthesized
tatgtcgtttttattctccctg

SEQ ID NO: 1402596 - DNA, 22 bp, Artificial Sequence
  chemically synthesized
atgtcgtttttattctccctga

SEQ ID NO: 1402597 - DNA, 22 bp, Artificial Sequence
  chemically synthesized
tgtcgtttttattctccctgaa

SEQ ID NO: 1402598 - DNA, 22 bp, Artificial Sequence
  chemically synthesized
ttattctccctgaaagtggcct

SEQ ID NO: 1402599 - DNA, 22 bp, Artificial Sequence
  chemically synthesized
tattctccctgaaagtggcctc

SEQ ID NO: 1402600 - DNA, 22 bp, Artificial Sequence
  chemically synthesized
attctccctgaaagtggcctca

SEQ ID NO: 1402601 - DNA, 22 bp, Artificial Sequence
  chemically synthesized
ttctccctgaaagtggcctcaa

SEQ ID NO: 1402602 - DNA, 22 bp, Artificial Sequence
  chemically synthesized
tccctgaaagtggcctcaaaca

SEQ ID NO: 1402603 - DNA, 22 bp, Artificial Sequence
  chemically synthesized
atgaagatagaatgtttgaggc

SEQ ID NO: 1402604 - DNA, 22 bp, Artificial Sequence
  chemically synthesized
cctgaaagtggcctcaaacatt

SEQ ID NO: 1402605 - DNA, 22 bp, Artificial Sequence
  chemically synthesized
aaagtggcctcaaacattctat

SEQ ID NO: 1402606 - DNA, 22 bp, Artificial Sequence
  chemically synthesized
aaacattctatcttcatcaaca

SEQ ID NO: 1402607 - DNA, 22 bp, Artificial Sequence
  chemically synthesized
tggtaaggataatgttgatgaa

SEQ ID NO: 1402608 - DNA, 22 bp, Artificial Sequence
  chemically synthesized
tatcttcatcaacattatcctt

SEQ ID NO: 1402609 - DNA, 22 bp, Artificial Sequence
  chemically synthesized
tcttcatcaacattatccttac

SEQ ID NO: 1402610 - DNA, 22 bp, Artificial Sequence
  chemically synthesized
catcaacattatccttaccaca

SEQ ID NO: 1402611 - DNA, 22 bp, Artificial Sequence
  chemically synthesized
atcaacattatccttaccacag

SEQ ID NO: 1402612 - DNA, 22 bp, Artificial Sequence
  chemically synthesized
ggaaaatgtgtaagtagcactg

SEQ ID NO: 1402613 - DNA, 22 bp, Artificial Sequence
  chemically synthesized
tccttaccacagtgctacttac

SEQ ID NO: 1402614 - DNA, 22 bp, Artificial Sequence
  chemically synthesized
accacagtgctacttacacatt

SEQ ID NO: 1402615 - DNA, 22 bp, Artificial Sequence
  chemically synthesized
ccacagtgctacttacacattt

SEQ ID NO: 1402616 - DNA, 22 bp, Artificial Sequence
  chemically synthesized
gtgataaattgggaaaatgtgt

SEQ ID NO: 1402617 - DNA, 22 bp, Artificial Sequence
  chemically synthesized
cttacacattttcccaatttat

SEQ ID NO: 1402618 - DNA, 22 bp, Artificial Sequence
  chemically synthesized
catgacagctggtgataaattg

SEQ ID NO: 1402619 - DNA, 22 bp, Artificial Sequence
  chemically synthesized
acacattttcccaatttatcac

SEQ ID NO: 1402620 - DNA, 22 bp, Artificial Sequence
  chemically synthesized
gcatgacagctggtgataaatt

SEQ ID NO: 1402621 - DNA, 22 bp, Artificial Sequence
  chemically synthesized
cacattttcccaatttatcacc

SEQ ID NO: 1402622 - DNA, 22 bp, Artificial Sequence
  chemically synthesized
tgcatgacagctggtgataaat

SEQ ID NO: 1402623 - DNA, 22 bp, Artificial Sequence
  chemically synthesized
ggttttgcatgacagctggtga

SEQ ID NO: 1402624 - DNA, 22 bp, Artificial Sequence
  chemically synthesized
tcccaatttatcaccagctgtc

SEQ ID NO: 1402625 - DNA, 22 bp, Artificial Sequence
  chemically synthesized
tgggttttgcatgacagctggt

SEQ ID NO: 1402626 - DNA, 22 bp, Artificial Sequence
  chemically synthesized
cccaatttatcaccagctgtca

SEQ ID NO: 1402627 - DNA, 22 bp, Artificial Sequence
  chemically synthesized
ccaatttatcaccagctgtcat

SEQ ID NO: 1402628 - DNA, 22 bp, Artificial Sequence
  chemically synthesized
ttctgggttttgcatgacagct

SEQ ID NO: 1402629 - DNA, 22 bp, Artificial Sequence
  chemically synthesized
gttctgggttttgcatgacagc

SEQ ID NO: 1402630 - DNA, 22 bp, Artificial Sequence
  chemically synthesized
tgttctgggttttgcatgacag

SEQ ID NO: 1402631 - DNA, 22 bp, Artificial Sequence
  chemically synthesized
atcaccagctgtcatgcaaaac

SEQ ID NO: 1402632 - DNA, 22 bp, Artificial Sequence
  chemically synthesized
tcaccagctgtcatgcaaaacc

SEQ ID NO: 1402633 - DNA, 22 bp, Artificial Sequence
  chemically synthesized
agtggctttgttctgggttttg

SEQ ID NO: 1402634 - DNA, 22 bp, Artificial Sequence
  chemically synthesized
gctaagtggctttgttctgggt

SEQ ID NO: 1402635 - DNA, 22 bp, Artificial Sequence
  chemically synthesized
ggctaagtggctttgttctggg

SEQ ID NO: 1402636 - DNA, 22 bp, Artificial Sequence
  chemically synthesized
tggctaagtggctttgttctgg

SEQ ID NO: 1402637 - DNA, 22 bp, Artificial Sequence
  chemically synthesized
tcatgcaaaacccagaacaaag

SEQ ID NO: 1402638 - DNA, 22 bp, Artificial Sequence
  chemically synthesized
atagtcaaacatgtgctttggc

SEQ ID NO: 1402639 - DNA, 22 bp, Artificial Sequence
  chemically synthesized
attcatagtcaaacatgtgctt

SEQ ID NO: 1402640 - DNA, 22 bp, Artificial Sequence
  chemically synthesized
agccaaagcacatgtttgacta

SEQ ID NO: 1402641 - DNA, 22 bp, Artificial Sequence
  chemically synthesized
gccaaagcacatgtttgactat

SEQ ID NO: 1402642 - DNA, 22 bp, Artificial Sequence
  chemically synthesized
aaaagaagaagtctaattcata

SEQ ID NO: 1402643 - DNA, 22 bp, Artificial Sequence
  chemically synthesized
aaaaagaagaagtctaattcat

SEQ ID NO: 1402644 - DNA, 22 bp, Artificial Sequence
  chemically synthesized
taaaaagaagaagtctaattca

SEQ ID NO: 1402645 - DNA, 22 bp, Artificial Sequence
  chemically synthesized
ttttaaaaagaagaagtctaat

SEQ ID NO: 1402646 - DNA, 22 bp, Artificial Sequence
  chemically synthesized
gttttaaaaagaagaagtctaa

SEQ ID NO: 1402647 - DNA, 22 bp, Artificial Sequence
  chemically synthesized
tgttttaaaaagaagaagtcta

SEQ ID NO: 1402648 - DNA, 22 bp, Artificial Sequence
  chemically synthesized
gactatgaattagacttcttct

SEQ ID NO: 1402649 - DNA, 22 bp, Artificial Sequence
  chemically synthesized
actatgaattagacttcttctt

SEQ ID NO: 1402650 - DNA, 22 bp, Artificial Sequence
  chemically synthesized
tgaattagacttcttcttttta

SEQ ID NO: 1402651 - DNA, 22 bp, Artificial Sequence
  chemically synthesized
aataatacctttgttttaaaaa

SEQ ID NO: 1402652 - DNA, 22 bp, Artificial Sequence
  chemically synthesized
aaataatacctttgttttaaaa

SEQ ID NO: 1402653 - DNA, 22 bp, Artificial Sequence
  chemically synthesized
gacttcttctttttaaaacaaa

SEQ ID NO: 1402654 - DNA, 22 bp, Artificial Sequence
  chemically synthesized
cttctttttaaaacaaaggtat

SEQ ID NO: 1402655 - DNA, 22 bp, Artificial Sequence
  chemically synthesized
ttctttttaaaacaaaggtatt

SEQ ID NO: 1402656 - DNA, 22 bp, Artificial Sequence
  chemically synthesized
ctttttaaaacaaaggtattat

SEQ ID NO: 1402657 - DNA, 22 bp, Artificial Sequence
  chemically synthesized
tttttaaaacaaaggtattatt

SEQ ID NO: 1402658 - DNA, 22 bp, Artificial Sequence
  chemically synthesized
tttaaaacaaaggtattattta

SEQ ID NO: 1402659 - DNA, 22 bp, Artificial Sequence
  chemically synthesized
ttaaaacaaaggtattatttaa

SEQ ID NO: 1402660 - DNA, 22 bp, Artificial Sequence
  chemically synthesized
taaaacaaaggtattatttaaa

SEQ ID NO: 1402661 - DNA, 22 bp, Artificial Sequence
  chemically synthesized
aaaacaaaggtattatttaaac

SEQ ID NO: 1402662 - DNA, 22 bp, Artificial Sequence
  chemically synthesized
aaacaaaggtattatttaaacc

SEQ ID NO: 1402663 - DNA, 22 bp, Artificial Sequence
  chemically synthesized
agatggaagccagcatcaatag

SEQ ID NO: 1402664 - DNA, 22 bp, Artificial Sequence
  chemically synthesized
aagatggaagccagcatcaata

SEQ ID NO: 1402665 - DNA, 22 bp, Artificial Sequence
  chemically synthesized
tttaaacctattgatgctggct

SEQ ID NO: 1402666 - DNA, 22 bp, Artificial Sequence
  chemically synthesized
aaacctattgatgctggcttcc

SEQ ID NO: 1402667 - DNA, 22 bp, Artificial Sequence
  chemically synthesized
tgggcttaagatggaagccagc

SEQ ID NO: 1402668 - DNA, 22 bp, Artificial Sequence
  chemically synthesized
aacctattgatgctggcttcca

SEQ ID NO: 1402669 - DNA, 22 bp, Artificial Sequence
  chemically synthesized
ttgatgctggcttccatcttaa

SEQ ID NO: 1402670 - DNA, 22 bp, Artificial Sequence
  chemically synthesized
ccagttatgggcttaagatgga

SEQ ID NO: 1402671 - DNA, 22 bp, Artificial Sequence
  chemically synthesized
atgctggcttccatcttaagcc

SEQ ID NO: 1402672 - DNA, 22 bp, Artificial Sequence
  chemically synthesized
gttgccagttatgggcttaaga

SEQ ID NO: 1402673 - DNA, 22 bp, Artificial Sequence
  chemically synthesized
ttggttgccagttatgggctta

SEQ ID NO: 1402674 - DNA, 22 bp, Artificial Sequence
  chemically synthesized
gcttccatcttaagcccataac

SEQ ID NO: 1402675 - DNA, 22 bp, Artificial Sequence
  chemically synthesized
acctgttggttgccagttatgg

SEQ ID NO: 1402676 - DNA, 22 bp, Artificial Sequence
  chemically synthesized
ccatcttaagcccataactggc

SEQ ID NO: 1402677 - DNA, 22 bp, Artificial Sequence
  chemically synthesized
catcttaagcccataactggca

SEQ ID NO: 1402678 - DNA, 22 bp, Artificial Sequence
  chemically synthesized
taacctgttggttgccagttat

SEQ ID NO: 1402679 - DNA, 22 bp, Artificial Sequence
  chemically synthesized
ctaacctgttggttgccagtta

SEQ ID NO: 1402680 - DNA, 22 bp, Artificial Sequence
  chemically synthesized
tctaacctgttggttgccagtt

SEQ ID NO: 1402681 - DNA, 22 bp, Artificial Sequence
  chemically synthesized
ttttctaacctgttggttgcca

SEQ ID NO: 1402682 - DNA, 22 bp, Artificial Sequence
  chemically synthesized
aagcccataactggcaaccaac

SEQ ID NO: 1402683 - DNA, 22 bp, Artificial Sequence
  chemically synthesized
attttctaacctgttggttgcc

SEQ ID NO: 1402684 - DNA, 22 bp, Artificial Sequence
  chemically synthesized
agcccataactggcaaccaaca

SEQ ID NO: 1402685 - DNA, 22 bp, Artificial Sequence
  chemically synthesized
tattttctaacctgttggttgc

SEQ ID NO: 1402686 - DNA, 22 bp, Artificial Sequence
  chemically synthesized
ggaaattttattttctaacctg

SEQ ID NO: 1402687 - DNA, 22 bp, Artificial Sequence
  chemically synthesized
gcaaccaacaggttagaaaata

SEQ ID NO: 1402688 - DNA, 22 bp, Artificial Sequence
  chemically synthesized
attaggaaattttattttctaa

SEQ ID NO: 1402689 - DNA, 22 bp, Artificial Sequence
  chemically synthesized
atcaattaattaggaaatttta

SEQ ID NO: 1402690 - DNA, 22 bp, Artificial Sequence
  chemically synthesized
ctaatcaattaattaggaaatt

SEQ ID NO: 1402691 - DNA, 22 bp, Artificial Sequence
  chemically synthesized
cctaatcaattaattaggaaat

SEQ ID NO: 1402692 - DNA, 22 bp, Artificial Sequence
  chemically synthesized
gaaaataaaatttcctaattaa

SEQ ID NO: 1402693 - DNA, 22 bp, Artificial Sequence
  chemically synthesized
atttcctaatcaattaattagg

SEQ ID NO: 1402694 - DNA, 22 bp, Artificial Sequence
  chemically synthesized
gttaatttcctaatcaattaat

SEQ ID NO: 1402695 - DNA, 22 bp, Artificial Sequence
  chemically synthesized
cctaattaattgattaggaaat

SEQ ID NO: 1402696 - DNA, 22 bp, Artificial Sequence
  chemically synthesized
ctaattaattgattaggaaatt

SEQ ID NO: 1402697 - DNA, 22 bp, Artificial Sequence
  chemically synthesized
attaattgattaggaaattaac

SEQ ID NO: 1402698 - DNA, 22 bp, Artificial Sequence
  chemically synthesized
attgattaggaaattaaccaat

SEQ ID NO: 1402699 - DNA, 22 bp, Artificial Sequence
  chemically synthesized
gatgtaacaaaaattggttaat

SEQ ID NO: 1402700 - DNA, 22 bp, Artificial Sequence
  chemically synthesized
attaggaaattaaccaattttt

SEQ ID NO: 1402701 - DNA, 22 bp, Artificial Sequence
  chemically synthesized
ggaaattaaccaatttttgtta

SEQ ID NO: 1402702 - DNA, 22 bp, Artificial Sequence
  chemically synthesized
accaatttttgttacatctaat

SEQ ID NO: 1402703 - DNA, 22 bp, Artificial Sequence
  chemically synthesized
ttgttacatctaatactggttg

SEQ ID NO: 1402704 - DNA, 22 bp, Artificial Sequence
  chemically synthesized
tgttacatctaatactggttgg

SEQ ID NO: 1402705 - DNA, 22 bp, Artificial Sequence
  chemically synthesized
gttacatctaatactggttgga

SEQ ID NO: 1402706 - DNA, 22 bp, Artificial Sequence
  chemically synthesized
ttacatctaatactggttggat

SEQ ID NO: 1402707 - DNA, 22 bp, Artificial Sequence
  chemically synthesized
gatgtaacaatacatccaacca

SEQ ID NO: 1402708 - DNA, 22 bp, Artificial Sequence
  chemically synthesized
catctaatactggttggatgta

SEQ ID NO: 1402709 - DNA, 22 bp, Artificial Sequence
  chemically synthesized
atactggttggatgtattgtta

SEQ ID NO: 1402710 - DNA, 22 bp, Artificial Sequence
  chemically synthesized
acaaacagtattggatgtaaca

SEQ ID NO: 1402711 - DNA, 22 bp, Artificial Sequence
  chemically synthesized
gttggatgtattgttacatcca

SEQ ID NO: 1402712 - DNA, 22 bp, Artificial Sequence
  chemically synthesized
cacaaacagtattggatgtaac

SEQ ID NO: 1402713 - DNA, 22 bp, Artificial Sequence
  chemically synthesized
tcacaaacagtattggatgtaa

SEQ ID NO: 1402714 - DNA, 22 bp, Artificial Sequence
  chemically synthesized
gatgtattgttacatccaatac

SEQ ID NO: 1402715 - DNA, 22 bp, Artificial Sequence
  chemically synthesized
ttacatccaatactgtttgtga

SEQ ID NO: 1402716 - DNA, 22 bp, Artificial Sequence
  chemically synthesized
catccaatactgtttgtgaaaa

SEQ ID NO: 1402717 - DNA, 22 bp, Artificial Sequence
  chemically synthesized
tttgtgaaaacttgtgctgttg

SEQ ID NO: 1402718 - DNA, 22 bp, Artificial Sequence
  chemically synthesized
gtgaaaacttgtgctgttggac

SEQ ID NO: 1402719 - DNA, 22 bp, Artificial Sequence
  chemically synthesized
tgaaaacttgtgctgttggact

SEQ ID NO: 1402720 - DNA, 22 bp, Artificial Sequence
  chemically synthesized
agtacaacaagcacaacaagtc

SEQ ID NO: 1402721 - DNA, 22 bp, Artificial Sequence
  chemically synthesized
gtgctgttggacttgttgtgct

SEQ ID NO: 1402722 - DNA, 22 bp, Artificial Sequence
  chemically synthesized
tgctgttggacttgttgtgctt

SEQ ID NO: 1402723 - DNA, 22 bp, Artificial Sequence
  chemically synthesized
ttggacttgttgtgcttgttgt

SEQ ID NO: 1402724 - DNA, 22 bp, Artificial Sequence
  chemically synthesized
agcaagactgagtacaacaagc

SEQ ID NO: 1402725 - DNA, 22 bp, Artificial Sequence
  chemically synthesized
gacttgttgtgcttgttgtact

SEQ ID NO: 1402726 - DNA, 22 bp, Artificial Sequence
  chemically synthesized
gttgtgcttgttgtactcagtc

SEQ ID NO: 1402727 - DNA, 22 bp, Artificial Sequence
  chemically synthesized
ttgtgcttgttgtactcagtct

SEQ ID NO: 1402728 - DNA, 22 bp, Artificial Sequence
  chemically synthesized
acaaattaagcaagactgagta

SEQ ID NO: 1402729 - DNA, 22 bp, Artificial Sequence
  chemically synthesized
cacaaattaagcaagactgagt

SEQ ID NO: 1402730 - DNA, 22 bp, Artificial Sequence
  chemically synthesized
tcacaaattaagcaagactgag

SEQ ID NO: 1402731 - DNA, 22 bp, Artificial Sequence
  chemically synthesized
tgcttgttgtactcagtcttgc

SEQ ID NO: 1402732 - DNA, 22 bp, Artificial Sequence
  chemically synthesized
gttgtactcagtcttgcttaat

SEQ ID NO: 1402733 - DNA, 22 bp, Artificial Sequence
  chemically synthesized
ttgtactcagtcttgcttaatt

SEQ ID NO: 1402734 - DNA, 22 bp, Artificial Sequence
  chemically synthesized
tactcagtcttgcttaatttgt

SEQ ID NO: 1402735 - DNA, 22 bp, Artificial Sequence
  chemically synthesized
aatgtgtgatgctttcacaaat

SEQ ID NO: 1402736 - DNA, 22 bp, Artificial Sequence
  chemically synthesized
agtcttgcttaatttgtgaaag

SEQ ID NO: 1402737 - DNA, 22 bp, Artificial Sequence
  chemically synthesized
aaatgtgtgatgctttcacaaa

SEQ ID NO: 1402738 - DNA, 22 bp, Artificial Sequence
  chemically synthesized
taaatgtgtgatgctttcacaa

SEQ ID NO: 1402739 - DNA, 22 bp, Artificial Sequence
  chemically synthesized
ctttaaatgtgtgatgctttca

SEQ ID NO: 1402740 - DNA, 22 bp, Artificial Sequence
  chemically synthesized
gcttaatttgtgaaagcatcac

SEQ ID NO: 1402741 - DNA, 22 bp, Artificial Sequence
  chemically synthesized
cttaatttgtgaaagcatcaca

SEQ ID NO: 1402742 - DNA, 22 bp, Artificial Sequence
  chemically synthesized
aatttgtgaaagcatcacacat

SEQ ID NO: 1402743 - DNA, 22 bp, Artificial Sequence
  chemically synthesized
atttgtgaaagcatcacacatt

SEQ ID NO: 1402744 - DNA, 22 bp, Artificial Sequence
  chemically synthesized
atgggctactttaaatgtgtga

SEQ ID NO: 1402745 - DNA, 22 bp, Artificial Sequence
  chemically synthesized
gtgaaagcatcacacatttaaa

SEQ ID NO: 1402746 - DNA, 22 bp, Artificial Sequence
  chemically synthesized
tgaaagcatcacacatttaaag

SEQ ID NO: 1402747 - DNA, 22 bp, Artificial Sequence
  chemically synthesized
gaaagcagctaatgggctactt

SEQ ID NO: 1402748 - DNA, 22 bp, Artificial Sequence
  chemically synthesized
agctagaaagcagctaatgggc

SEQ ID NO: 1402749 - DNA, 22 bp, Artificial Sequence
  chemically synthesized
aaagtagcccattagctgcttt

SEQ ID NO: 1402750 - DNA, 22 bp, Artificial Sequence
  chemically synthesized
atcctcagctagaaagcagcta

SEQ ID NO: 1402751 - DNA, 22 bp, Artificial Sequence
  chemically synthesized
aagtagcccattagctgctttc

SEQ ID NO: 1402752 - DNA, 22 bp, Artificial Sequence
  chemically synthesized
ctcatcctcagctagaaagcag

SEQ ID NO: 1402753 - DNA, 22 bp, Artificial Sequence
  chemically synthesized
cctactcatcctcagctagaaa

SEQ ID NO: 1402754 - DNA, 22 bp, Artificial Sequence
  chemically synthesized
acctactcatcctcagctagaa

SEQ ID NO: 1402755 - DNA, 22 bp, Artificial Sequence
  chemically synthesized
tacctactcatcctcagctaga

SEQ ID NO: 1402756 - DNA, 22 bp, Artificial Sequence
  chemically synthesized
tctttacctactcatcctcagc

SEQ ID NO: 1402757 - DNA, 22 bp, Artificial Sequence
  chemically synthesized
gctgctttctagctgaggatga

SEQ ID NO: 1402758 - DNA, 22 bp, Artificial Sequence
  chemically synthesized
ctttctagctgaggatgagtag

SEQ ID NO: 1402759 - DNA, 22 bp, Artificial Sequence
  chemically synthesized
tctagctgaggatgagtaggta

SEQ ID NO: 1402760 - DNA, 22 bp, Artificial Sequence
  chemically synthesized
ctagctgaggatgagtaggtaa

SEQ ID NO: 1402761 - DNA, 22 bp, Artificial Sequence
  chemically synthesized
tagctgaggatgagtaggtaaa

SEQ ID NO: 1402762 - DNA, 22 bp, Artificial Sequence
  chemically synthesized
gctgaggatgagtaggtaaaga

SEQ ID NO: 1402763 - DNA, 22 bp, Artificial Sequence
  chemically synthesized
aggatgagtaggtaaagacaat

SEQ ID NO: 1402764 - DNA, 22 bp, Artificial Sequence
  chemically synthesized
caaatgtagaaataattgtctt

SEQ ID NO: 1402765 - DNA, 22 bp, Artificial Sequence
  chemically synthesized
caactacaaatgtagaaataat

SEQ ID NO: 1402766 - DNA, 22 bp, Artificial Sequence
  chemically synthesized
ccaactacaaatgtagaaataa

SEQ ID NO: 1402767 - DNA, 22 bp, Artificial Sequence
  chemically synthesized
cttccaactacaaatgtagaaa

SEQ ID NO: 1402768 - DNA, 22 bp, Artificial Sequence
  chemically synthesized
cgactacttccaactacaaatg

SEQ ID NO: 1402769 - DNA, 22 bp, Artificial Sequence
  chemically synthesized
tttctacatttgtagttggaag

SEQ ID NO: 1402770 - DNA, 22 bp, Artificial Sequence
  chemically synthesized
ctacatttgtagttggaagtag

SEQ ID NO: 1402771 - DNA, 22 bp, Artificial Sequence
  chemically synthesized
tacatttgtagttggaagtagt

SEQ ID NO: 1402772 - DNA, 22 bp, Artificial Sequence
  chemically synthesized
gataatatctacgactacttcc

SEQ ID NO: 1402773 - DNA, 22 bp, Artificial Sequence
  chemically synthesized
catttgtagttggaagtagtcg

SEQ ID NO: 1402774 - DNA, 22 bp, Artificial Sequence
  chemically synthesized
aattagataatatctacgacta

SEQ ID NO: 1402775 - DNA, 22 bp, Artificial Sequence
  chemically synthesized
gtagttggaagtagtcgtagat

SEQ ID NO: 1402776 - DNA, 22 bp, Artificial Sequence
  chemically synthesized
tagttggaagtagtcgtagata

SEQ ID NO: 1402777 - DNA, 22 bp, Artificial Sequence
  chemically synthesized
gaagtagtcgtagatattatct

SEQ ID NO: 1402778 - DNA, 22 bp, Artificial Sequence
  chemically synthesized
aagaaagccactgaattagata

SEQ ID NO: 1402779 - DNA, 22 bp, Artificial Sequence
  chemically synthesized
gaagaaagccactgaattagat

SEQ ID NO: 1402780 - DNA, 22 bp, Artificial Sequence
  chemically synthesized
agatcttgaagaaagccactga

SEQ ID NO: 1402781 - DNA, 22 bp, Artificial Sequence
  chemically synthesized
tctaattcagtggctttcttca

SEQ ID NO: 1402782 - DNA, 22 bp, Artificial Sequence
  chemically synthesized
attcagtggctttcttcaagat

SEQ ID NO: 1402783 - DNA, 22 bp, Artificial Sequence
  chemically synthesized
tagaaaactgagatcttgaaga

SEQ ID NO: 1402784 - DNA, 22 bp, Artificial Sequence
  chemically synthesized
agtggctttcttcaagatctca

SEQ ID NO: 1402785 - DNA, 22 bp, Artificial Sequence
  chemically synthesized
tcttcaagatctcagttttcta

SEQ ID NO: 1402786 - DNA, 22 bp, Artificial Sequence
  chemically synthesized
cttcaagatctcagttttctac

SEQ ID NO: 1402787 - DNA, 22 bp, Artificial Sequence
  chemically synthesized
ttcaagatctcagttttctaca

SEQ ID NO: 1402788 - DNA, 22 bp, Artificial Sequence
  chemically synthesized
caagatctcagttttctacagc

SEQ ID NO: 1402789 - DNA, 22 bp, Artificial Sequence
  chemically synthesized
aagatctcagttttctacagct

SEQ ID NO: 1402790 - DNA, 22 bp, Artificial Sequence
  chemically synthesized
taaccccatagacacagctgta

SEQ ID NO: 1402791 - DNA, 22 bp, Artificial Sequence
  chemically synthesized
agttttctacagctgtgtctat

SEQ ID NO: 1402792 - DNA, 22 bp, Artificial Sequence
  chemically synthesized
accctataaccccatagacaca

SEQ ID NO: 1402793 - DNA, 22 bp, Artificial Sequence
  chemically synthesized
caccctataaccccatagacac

SEQ ID NO: 1402794 - DNA, 22 bp, Artificial Sequence
  chemically synthesized
tcaccctataaccccatagaca

SEQ ID NO: 1402795 - DNA, 22 bp, Artificial Sequence
  chemically synthesized
tctacagctgtgtctatggggt

SEQ ID NO: 1402796 - DNA, 22 bp, Artificial Sequence
  chemically synthesized
ctacagctgtgtctatggggtt

SEQ ID NO: 1402797 - DNA, 22 bp, Artificial Sequence
  chemically synthesized
tacagctgtgtctatggggtta

SEQ ID NO: 1402798 - DNA, 22 bp, Artificial Sequence
  chemically synthesized
cagctgtgtctatggggttata

SEQ ID NO: 1402799 - DNA, 22 bp, Artificial Sequence
  chemically synthesized
caactttcaccctataacccca

SEQ ID NO: 1402800 - DNA, 22 bp, Artificial Sequence
  chemically synthesized
ttccaactttcaccctataacc

SEQ ID NO: 1402801 - DNA, 22 bp, Artificial Sequence
  chemically synthesized
attccaactttcaccctataac

SEQ ID NO: 1402802 - DNA, 22 bp, Artificial Sequence
  chemically synthesized
tgtctatggggttatagggtga

SEQ ID NO: 1402803 - DNA, 22 bp, Artificial Sequence
  chemically synthesized
ccatttattccaactttcaccc

SEQ ID NO: 1402804 - DNA, 22 bp, Artificial Sequence
  chemically synthesized
tggggttatagggtgaaagttg

SEQ ID NO: 1402805 - DNA, 22 bp, Artificial Sequence
  chemically synthesized
aactgccatttattccaacttt

SEQ ID NO: 1402806 - DNA, 22 bp, Artificial Sequence
  chemically synthesized
attcaactgccatttattccaa

SEQ ID NO: 1402807 - DNA, 22 bp, Artificial Sequence
  chemically synthesized
tagggtgaaagttggaataaat

SEQ ID NO: 1402808 - DNA, 22 bp, Artificial Sequence
  chemically synthesized
gattcaactgccatttattcca

SEQ ID NO: 1402809 - DNA, 22 bp, Artificial Sequence
  chemically synthesized
gaataaatggcagttgaatcaa

SEQ ID NO: 1402810 - DNA, 22 bp, Artificial Sequence
  chemically synthesized
aatgaaaacaagaggacgattt

SEQ ID NO: 1402811 - DNA, 22 bp, Artificial Sequence
  chemically synthesized
gaatgaaaacaagaggacgatt

SEQ ID NO: 1402812 - DNA, 22 bp, Artificial Sequence
  chemically synthesized
aatcaaatcgtcctcttgtttt

SEQ ID NO: 1402813 - DNA, 22 bp, Artificial Sequence
  chemically synthesized
aaggtgtagacatcttgaatga

SEQ ID NO: 1402814 - DNA, 22 bp, Artificial Sequence
  chemically synthesized
ttgttttcattcaagatgtcta

SEQ ID NO: 1402815 - DNA, 22 bp, Artificial Sequence
  chemically synthesized
gttttcattcaagatgtctaca

SEQ ID NO: 1402816 - DNA, 22 bp, Artificial Sequence
  chemically synthesized
ttttcattcaagatgtctacac

SEQ ID NO: 1402817 - DNA, 22 bp, Artificial Sequence
  chemically synthesized
tcattcaagatgtctacacctt

SEQ ID NO: 1402818 - DNA, 22 bp, Artificial Sequence
  chemically synthesized
cattcaagatgtctacaccttc

SEQ ID NO: 1402819 - DNA, 22 bp, Artificial Sequence
  chemically synthesized
attcaagatgtctacaccttca

SEQ ID NO: 1402820 - DNA, 22 bp, Artificial Sequence
  chemically synthesized
aagatgtctacaccttcaattc

SEQ ID NO: 1402821 - DNA, 22 bp, Artificial Sequence
  chemically synthesized
caccttcaattcttcttttctt

SEQ ID NO: 1402822 - DNA, 22 bp, Artificial Sequence
  chemically synthesized
atatgaaagcccagcaaagaaa

SEQ ID NO: 1402823 - DNA, 22 bp, Artificial Sequence
  chemically synthesized
caattcttcttttctttgctgg

SEQ ID NO: 1402824 - DNA, 22 bp, Artificial Sequence
  chemically synthesized
aattcttcttttctttgctggg

SEQ ID NO: 1402825 - DNA, 22 bp, Artificial Sequence
  chemically synthesized
ttcttttctttgctgggctttc

SEQ ID NO: 1402826 - DNA, 22 bp, Artificial Sequence
  chemically synthesized
aaaatctcatatgaaagcccag

SEQ ID NO: 1402827 - DNA, 22 bp, Artificial Sequence
  chemically synthesized
aaaaatctcatatgaaagccca

SEQ ID NO: 1402828 - DNA, 22 bp, Artificial Sequence
  chemically synthesized
cttttctttgctgggctttcat

SEQ ID NO: 1402829 - DNA, 22 bp, Artificial Sequence
  chemically synthesized
taaaaatctcatatgaaagccc

SEQ ID NO: 1402830 - DNA, 22 bp, Artificial Sequence
  chemically synthesized
ttttctttgctgggctttcata

SEQ ID NO: 1402831 - DNA, 22 bp, Artificial Sequence
  chemically synthesized
ttaaaaatctcatatgaaagcc

SEQ ID NO: 1402832 - DNA, 22 bp, Artificial Sequence
  chemically synthesized
tttaaaaatctcatatgaaagc

SEQ ID NO: 1402833 - DNA, 22 bp, Artificial Sequence
  chemically synthesized
ttctttgctgggctttcatatg

SEQ ID NO: 1402834 - DNA, 22 bp, Artificial Sequence
  chemically synthesized
ttttaaaaatctcatatgaaag

SEQ ID NO: 1402835 - DNA, 22 bp, Artificial Sequence
  chemically synthesized
tctttgctgggctttcatatga

SEQ ID NO: 1402836 - DNA, 22 bp, Artificial Sequence
  chemically synthesized
ctttgctgggctttcatatgag

SEQ ID NO: 1402837 - DNA, 22 bp, Artificial Sequence
  chemically synthesized
tttgctgggctttcatatgaga

SEQ ID NO: 1402838 - DNA, 22 bp, Artificial Sequence
  chemically synthesized
tgctgggctttcatatgagatt

SEQ ID NO: 1402839 - DNA, 22 bp, Artificial Sequence
  chemically synthesized
gctgggctttcatatgagattt

SEQ ID NO: 1402840 - DNA, 22 bp, Artificial Sequence
  chemically synthesized
ctgggctttcatatgagatttt

SEQ ID NO: 1402841 - DNA, 22 bp, Artificial Sequence
  chemically synthesized
ggctttcatatgagatttttaa

SEQ ID NO: 1402842 - DNA, 22 bp, Artificial Sequence
  chemically synthesized
tcatatgagatttttaaaaaaa

SEQ ID NO: 1402843 - DNA, 22 bp, Artificial Sequence
  chemically synthesized
catatgagatttttaaaaaaat

SEQ ID NO: 1402844 - DNA, 22 bp, Artificial Sequence
  chemically synthesized
atatgagatttttaaaaaaatg

SEQ ID NO: 1402845 - DNA, 22 bp, Artificial Sequence
  chemically synthesized
aaaatacacaggacacattttt

SEQ ID NO: 1402846 - DNA, 22 bp, Artificial Sequence
  chemically synthesized
aaaaatacacaggacacatttt

SEQ ID NO: 1402847 - DNA, 22 bp, Artificial Sequence
  chemically synthesized
taaaaatacacaggacacattt

SEQ ID NO: 1402848 - DNA, 22 bp, Artificial Sequence
  chemically synthesized
attttaaaaatacacaggacac

SEQ ID NO: 1402849 - DNA, 22 bp, Artificial Sequence
  chemically synthesized
cattttaaaaatacacaggaca

SEQ ID NO: 1402850 - DNA, 22 bp, Artificial Sequence
  chemically synthesized
ttaaaaaaatgtgtcctgtgta

SEQ ID NO: 1402851 - DNA, 22 bp, Artificial Sequence
  chemically synthesized
taaaaaaatgtgtcctgtgtat

SEQ ID NO: 1402852 - DNA, 22 bp, Artificial Sequence
  chemically synthesized
aaaaaaatgtgtcctgtgtatt

SEQ ID NO: 1402853 - DNA, 22 bp, Artificial Sequence
  chemically synthesized
aaaaaatgtgtcctgtgtattt

SEQ ID NO: 1402854 - DNA, 22 bp, Artificial Sequence
  chemically synthesized
taatagatcaagtttcatttta

SEQ ID NO: 1402855 - DNA, 22 bp, Artificial Sequence
  chemically synthesized
tgtatttttaaaatgaaacttg

SEQ ID NO: 1402856 - DNA, 22 bp, Artificial Sequence
  chemically synthesized
ttaaaatgaaacttgatctatt

SEQ ID NO: 1402857 - DNA, 22 bp, Artificial Sequence
  chemically synthesized
taaaatgaaacttgatctatta

SEQ ID NO: 1402858 - DNA, 22 bp, Artificial Sequence
  chemically synthesized
tagaatatactgtaatagatca

SEQ ID NO: 1402859 - DNA, 22 bp, Artificial Sequence
  chemically synthesized
aaaatgaaacttgatctattac

SEQ ID NO: 1402860 - DNA, 22 bp, Artificial Sequence
  chemically synthesized
aaatgaaacttgatctattaca

SEQ ID NO: 1402861 - DNA, 22 bp, Artificial Sequence
  chemically synthesized
ccaactgtagaatatactgtaa

SEQ ID NO: 1402862 - DNA, 22 bp, Artificial Sequence
  chemically synthesized
gccaactgtagaatatactgta

SEQ ID NO: 1402863 - DNA, 22 bp, Artificial Sequence
  chemically synthesized
gatctattacagtatattctac

SEQ ID NO: 1402864 - DNA, 22 bp, Artificial Sequence
  chemically synthesized
atctattacagtatattctaca

SEQ ID NO: 1402865 - DNA, 22 bp, Artificial Sequence
  chemically synthesized
atatatttgccaactgtagaat

SEQ ID NO: 1402866 - DNA, 22 bp, Artificial Sequence
  chemically synthesized
catatatttgccaactgtagaa

SEQ ID NO: 1402867 - DNA, 22 bp, Artificial Sequence
  chemically synthesized
ttacagtatattctacagttgg

SEQ ID NO: 1402868 - DNA, 22 bp, Artificial Sequence
  chemically synthesized
cagtatattctacagttggcaa

SEQ ID NO: 1402869 - DNA, 22 bp, Artificial Sequence
  chemically synthesized
tacagttggcaaatatatgaaa

SEQ ID NO: 1402870 - DNA, 22 bp, Artificial Sequence
  chemically synthesized
cagttggcaaatatatgaaata

SEQ ID NO: 1402871 - DNA, 22 bp, Artificial Sequence
  chemically synthesized
gcaaatatatgaaatattttct

SEQ ID NO: 1402872 - DNA, 22 bp, Artificial Sequence
  chemically synthesized
ggcatgaatgcagtgggaagga

SEQ ID NO: 1402873 - DNA, 22 bp, Artificial Sequence
  chemically synthesized
tctatccttcccactgcattca

SEQ ID NO: 1402874 - DNA, 22 bp, Artificial Sequence
  chemically synthesized
ctatccttcccactgcattcat

SEQ ID NO: 1402875 - DNA, 22 bp, Artificial Sequence
  chemically synthesized
tatccttcccactgcattcatg

SEQ ID NO: 1402876 - DNA, 22 bp, Artificial Sequence
  chemically synthesized
tccttcccactgcattcatgcc

SEQ ID NO: 1402877 - DNA, 22 bp, Artificial Sequence
  chemically synthesized
atgccgtatgtgctcggcatga

SEQ ID NO: 1402878 - DNA, 22 bp, Artificial Sequence
  chemically synthesized
gatgccgtatgtgctcggcatg

SEQ ID NO: 1402879 - DNA, 22 bp, Artificial Sequence
  chemically synthesized
cccactgcattcatgccgagca

SEQ ID NO: 1402880 - DNA, 22 bp, Artificial Sequence
  chemically synthesized
ccactgcattcatgccgagcac

SEQ ID NO: 1402881 - DNA, 22 bp, Artificial Sequence
  chemically synthesized
tttgatgccgtatgtgctcggc

SEQ ID NO: 1402882 - DNA, 22 bp, Artificial Sequence
  chemically synthesized
cattcatgccgagcacatacgg

SEQ ID NO: 1402883 - DNA, 22 bp, Artificial Sequence
  chemically synthesized
atgccgagcacatacggcatca

SEQ ID NO: 1402884 - DNA, 22 bp, Artificial Sequence
  chemically synthesized
gtgggataaaataccattattt

SEQ ID NO: 1402885 - DNA, 22 bp, Artificial Sequence
  chemically synthesized
gaactcgtgggataaaatacca

SEQ ID NO: 1402886 - DNA, 22 bp, Artificial Sequence
  chemically synthesized
ggaactcgtgggataaaatacc

SEQ ID NO: 1402887 - DNA, 22 bp, Artificial Sequence
  chemically synthesized
cttggaactcgtgggataaaat

SEQ ID NO: 1402888 - DNA, 22 bp, Artificial Sequence
  chemically synthesized
tatctacttggaactcgtggga

SEQ ID NO: 1402889 - DNA, 22 bp, Artificial Sequence
  chemically synthesized
agactgtatctacttggaactc

SEQ ID NO: 1402890 - DNA, 22 bp, Artificial Sequence
  chemically synthesized
tatcccacgagttccaagtaga

SEQ ID NO: 1402891 - DNA, 22 bp, Artificial Sequence
  chemically synthesized
atcccacgagttccaagtagat

SEQ ID NO: 1402892 - DNA, 22 bp, Artificial Sequence
  chemically synthesized
tcccacgagttccaagtagata

SEQ ID NO: 1402893 - DNA, 22 bp, Artificial Sequence
  chemically synthesized
taacagactgagactgtatcta

SEQ ID NO: 1402894 - DNA, 22 bp, Artificial Sequence
  chemically synthesized
caagtagatacagtctcagtct

SEQ ID NO: 1402895 - DNA, 22 bp, Artificial Sequence
  chemically synthesized
caggagtactataacagactga

SEQ ID NO: 1402896 - DNA, 22 bp, Artificial Sequence
  chemically synthesized
ccaggagtactataacagactg

SEQ ID NO: 1402897 - DNA, 22 bp, Artificial Sequence
  chemically synthesized
atagtagtttccaggagtacta

SEQ ID NO: 1402898 - DNA, 22 bp, Artificial Sequence
  chemically synthesized
gatagtagtttccaggagtact

SEQ ID NO: 1402899 - DNA, 22 bp, Artificial Sequence
  chemically synthesized
agtctgttatagtactcctgga

SEQ ID NO: 1402900 - DNA, 22 bp, Artificial Sequence
  chemically synthesized
cttgatagtagtttccaggagt

SEQ ID NO: 1402901 - DNA, 22 bp, Artificial Sequence
  chemically synthesized
ttatagtactcctggaaactac

SEQ ID NO: 1402902 - DNA, 22 bp, Artificial Sequence
  chemically synthesized
tagtactcctggaaactactat

SEQ ID NO: 1402903 - DNA, 22 bp, Artificial Sequence
  chemically synthesized
ctggaaactactatcaagcaat

SEQ ID NO: 1402904 - DNA, 22 bp, Artificial Sequence
  chemically synthesized
gaaactactatcaagcaattgc

SEQ ID NO: 1402905 - DNA, 22 bp, Artificial Sequence
  chemically synthesized
atcacaccatgtgcaattgctt

SEQ ID NO: 1402906 - DNA, 22 bp, Artificial Sequence
  chemically synthesized
ctatcaagcaattgcacatggt

SEQ ID NO: 1402907 - DNA, 22 bp, Artificial Sequence
  chemically synthesized
tcaagcaattgcacatggtgtg

SEQ ID NO: 1402908 - DNA, 22 bp, Artificial Sequence
  chemically synthesized
cacatggtgtgatcaacatttg

SEQ ID NO: 1402909 - DNA, 22 bp, Artificial Sequence
  chemically synthesized
gttatcttttctatcactttct

SEQ ID NO: 1402910 - DNA, 22 bp, Artificial Sequence
  chemically synthesized
ttatcttttctatcactttcta

SEQ ID NO: 1402911 - DNA, 22 bp, Artificial Sequence
  chemically synthesized
aagaataaagaagatagaaagt

SEQ ID NO: 1402912 - DNA, 22 bp, Artificial Sequence
  chemically synthesized
tcttttctatcactttctatct

SEQ ID NO: 1402913 - DNA, 22 bp, Artificial Sequence
  chemically synthesized
ttctatcactttctatcttctt

SEQ ID NO: 1402914 - DNA, 22 bp, Artificial Sequence
  chemically synthesized
tctatcactttctatcttcttt

SEQ ID NO: 1402915 - DNA, 22 bp, Artificial Sequence
  chemically synthesized
ctatcactttctatcttcttta

SEQ ID NO: 1402916 - DNA, 22 bp, Artificial Sequence
  chemically synthesized
tatcactttctatcttctttat

SEQ ID NO: 1402917 - DNA, 22 bp, Artificial Sequence
  chemically synthesized
tcactttctatcttctttattc

SEQ ID NO: 1402918 - DNA, 22 bp, Artificial Sequence
  chemically synthesized
caaatcattaaagaataaagaa

SEQ ID NO: 1402919 - DNA, 22 bp, Artificial Sequence
  chemically synthesized
gattacaaatcattaaagaata

SEQ ID NO: 1402920 - DNA, 22 bp, Artificial Sequence
  chemically synthesized
tctatcttctttattctttaat

SEQ ID NO: 1402921 - DNA, 22 bp, Artificial Sequence
  chemically synthesized
ctatcttctttattctttaatg

SEQ ID NO: 1402922 - DNA, 22 bp, Artificial Sequence
  chemically synthesized
tatcttctttattctttaatga

SEQ ID NO: 1402923 - DNA, 22 bp, Artificial Sequence
  chemically synthesized
tcttctttattctttaatgatt

SEQ ID NO: 1402924 - DNA, 22 bp, Artificial Sequence
  chemically synthesized
ctttattctttaatgatttgta

SEQ ID NO: 1402925 - DNA, 22 bp, Artificial Sequence
  chemically synthesized
tttattctttaatgatttgtaa

SEQ ID NO: 1402926 - DNA, 22 bp, Artificial Sequence
  chemically synthesized
tattctttaatgatttgtaatc

SEQ ID NO: 1402927 - DNA, 22 bp, Artificial Sequence
  chemically synthesized
attctttaatgatttgtaatcg

SEQ ID NO: 1402928 - DNA, 22 bp, Artificial Sequence
  chemically synthesized
ttctttaatgatttgtaatcga

SEQ ID NO: 1402929 - DNA, 22 bp, Artificial Sequence
  chemically synthesized
tttaatgatttgtaatcgaatg

SEQ ID NO: 1402930 - DNA, 22 bp, Artificial Sequence
  chemically synthesized
aaaaaatggaagcattcgatta

SEQ ID NO: 1402931 - DNA, 22 bp, Artificial Sequence
  chemically synthesized
taatgatttgtaatcgaatgct

SEQ ID NO: 1402932 - DNA, 22 bp, Artificial Sequence
  chemically synthesized
tgaaaaaatggaagcattcgat

SEQ ID NO: 1402933 - DNA, 22 bp, Artificial Sequence
  chemically synthesized
aatgatttgtaatcgaatgctt

SEQ ID NO: 1402934 - DNA, 22 bp, Artificial Sequence
  chemically synthesized
ctgaaaaaatggaagcattcga

SEQ ID NO: 1402935 - DNA, 22 bp, Artificial Sequence
  chemically synthesized
atgatttgtaatcgaatgcttc

SEQ ID NO: 1402936 - DNA, 22 bp, Artificial Sequence
  chemically synthesized
ttctgaaaaaatggaagcattc

SEQ ID NO: 1402937 - DNA, 22 bp, Artificial Sequence
  chemically synthesized
tcttctgaaaaaatggaagcat

SEQ ID NO: 1402938 - DNA, 22 bp, Artificial Sequence
  chemically synthesized
ttctcttctgaaaaaatggaag

SEQ ID NO: 1402939 - DNA, 22 bp, Artificial Sequence
  chemically synthesized
gtaatcgaatgcttccattttt

SEQ ID NO: 1402940 - DNA, 22 bp, Artificial Sequence
  chemically synthesized
attctcttctgaaaaaatggaa

SEQ ID NO: 1402941 - DNA, 22 bp, Artificial Sequence
  chemically synthesized
taatcgaatgcttccatttttt

SEQ ID NO: 1402942 - DNA, 22 bp, Artificial Sequence
  chemically synthesized
tattctcttctgaaaaaatgga

SEQ ID NO: 1402943 - DNA, 22 bp, Artificial Sequence
  chemically synthesized
ttattctcttctgaaaaaatgg

SEQ ID NO: 1402944 - DNA, 22 bp, Artificial Sequence
  chemically synthesized
ggccttttattctcttctgaaa

SEQ ID NO: 1402945 - DNA, 22 bp, Artificial Sequence
  chemically synthesized
tgggccttttattctcttctga

SEQ ID NO: 1402946 - DNA, 22 bp, Artificial Sequence
  chemically synthesized
ccattttttcagaagagaataa

SEQ ID NO: 1402947 - DNA, 22 bp, Artificial Sequence
  chemically synthesized
cattttttcagaagagaataaa

SEQ ID NO: 1402948 - DNA, 22 bp, Artificial Sequence
  chemically synthesized
ccattctgggccttttattctc

SEQ ID NO: 1402949 - DNA, 22 bp, Artificial Sequence
  chemically synthesized
tttcagaagagaataaaaggcc

SEQ ID NO: 1402950 - DNA, 22 bp, Artificial Sequence
  chemically synthesized
ttcagaagagaataaaaggccc

SEQ ID NO: 1402951 - DNA, 22 bp, Artificial Sequence
  chemically synthesized
tcagaagagaataaaaggccca

SEQ ID NO: 1402952 - DNA, 22 bp, Artificial Sequence
  chemically synthesized
cagaagagaataaaaggcccag

SEQ ID NO: 1402953 - DNA, 22 bp, Artificial Sequence
  chemically synthesized
agaagagaataaaaggcccaga

SEQ ID NO: 1402954 - DNA, 22 bp, Artificial Sequence
  chemically synthesized
gtaacagtcattaccattctgg

SEQ ID NO: 1402955 - DNA, 22 bp, Artificial Sequence
  chemically synthesized
ggtaacagtcattaccattctg

SEQ ID NO: 1402956 - DNA, 22 bp, Artificial Sequence
  chemically synthesized
catcgtgacttggtaacagtca

SEQ ID NO: 1402957 - DNA, 22 bp, Artificial Sequence
  chemically synthesized
ctacatcgtgacttggtaacag

SEQ ID NO: 1402958 - DNA, 22 bp, Artificial Sequence
  chemically synthesized
gctacatcgtgacttggtaaca

SEQ ID NO: 1402959 - DNA, 22 bp, Artificial Sequence
  chemically synthesized
tgctacatcgtgacttggtaac

SEQ ID NO: 1402960 - DNA, 22 bp, Artificial Sequence
  chemically synthesized
ttaccaagtcacgatgtagcaa

SEQ ID NO: 1402961 - DNA, 22 bp, Artificial Sequence
  chemically synthesized
ccaagtcacgatgtagcaaaat

SEQ ID NO: 1402962 - DNA, 22 bp, Artificial Sequence
  chemically synthesized
tcagaagtgacacaccaatttt

SEQ ID NO: 1402963 - DNA, 22 bp, Artificial Sequence
  chemically synthesized
gagaaactgtcagaagtgacac

SEQ ID NO: 1402964 - DNA, 22 bp, Artificial Sequence
  chemically synthesized
ggagttagagaaactgtcagaa

SEQ ID NO: 1402965 - DNA, 22 bp, Artificial Sequence
  chemically synthesized
gggagttagagaaactgtcaga

SEQ ID NO: 1402966 - DNA, 22 bp, Artificial Sequence
  chemically synthesized
gtgtgtcacttctgacagtttc

SEQ ID NO: 1402967 - DNA, 22 bp, Artificial Sequence
  chemically synthesized
gtttgggagttagagaaactgt

SEQ ID NO: 1402968 - DNA, 22 bp, Artificial Sequence
  chemically synthesized
ctgacagtttctctaactccca

SEQ ID NO: 1402969 - DNA, 22 bp, Artificial Sequence
  chemically synthesized
tgacagtttctctaactcccaa

SEQ ID NO: 1402970 - DNA, 22 bp, Artificial Sequence
  chemically synthesized
acagtttctctaactcccaaac

SEQ ID NO: 1402971 - DNA, 22 bp, Artificial Sequence
  chemically synthesized
tcaaaatatgcattggtttggg

SEQ ID NO: 1402972 - DNA, 22 bp, Artificial Sequence
  chemically synthesized
ctctaactcccaaaccaatgca

SEQ ID NO: 1402973 - DNA, 22 bp, Artificial Sequence
  chemically synthesized
tctaactcccaaaccaatgcat

SEQ ID NO: 1402974 - DNA, 22 bp, Artificial Sequence
  chemically synthesized
taactcccaaaccaatgcatat

SEQ ID NO: 1402975 - DNA, 22 bp, Artificial Sequence
  chemically synthesized
actcccaaaccaatgcatattt

SEQ ID NO: 1402976 - DNA, 22 bp, Artificial Sequence
  chemically synthesized
ccaaaccaatgcatattttgat

SEQ ID NO: 1402977 - DNA, 22 bp, Artificial Sequence
  chemically synthesized
aggaaataatgagggcaattat

SEQ ID NO: 1402978 - DNA, 22 bp, Artificial Sequence
  chemically synthesized
gaggaaataatgagggcaatta

SEQ ID NO: 1402979 - DNA, 22 bp, Artificial Sequence
  chemically synthesized
tgataattgccctcattatttc

SEQ ID NO: 1402980 - DNA, 22 bp, Artificial Sequence
  chemically synthesized
gataattgccctcattatttcc

SEQ ID NO: 1402981 - DNA, 22 bp, Artificial Sequence
  chemically synthesized
ataattgccctcattatttcct

SEQ ID NO: 1402982 - DNA, 22 bp, Artificial Sequence
  chemically synthesized
acagggaagtatatttgaggaa

SEQ ID NO: 1402983 - DNA, 22 bp, Artificial Sequence
  chemically synthesized
ccctcattatttcctcaaatat

SEQ ID NO: 1402984 - DNA, 22 bp, Artificial Sequence
  chemically synthesized
tgacagggaagtatatttgagg

SEQ ID NO: 1402985 - DNA, 22 bp, Artificial Sequence
  chemically synthesized
ctgacagggaagtatatttgag

SEQ ID NO: 1402986 - DNA, 22 bp, Artificial Sequence
  chemically synthesized
tctgacagggaagtatatttga

SEQ ID NO: 1402987 - DNA, 22 bp, Artificial Sequence
  chemically synthesized
ttctgacagggaagtatatttg

SEQ ID NO: 1402988 - DNA, 22 bp, Artificial Sequence
  chemically synthesized
tttctgacagggaagtatattt

SEQ ID NO: 1402989 - DNA, 22 bp, Artificial Sequence
  chemically synthesized
attatttcctcaaatatacttc

SEQ ID NO: 1402990 - DNA, 22 bp, Artificial Sequence
  chemically synthesized
ttttctgacagggaagtatatt

SEQ ID NO: 1402991 - DNA, 22 bp, Artificial Sequence
  chemically synthesized
tttcctcaaatatacttccctg

SEQ ID NO: 1402992 - DNA, 22 bp, Artificial Sequence
  chemically synthesized
cctcaaatatacttccctgtca

SEQ ID NO: 1402993 - DNA, 22 bp, Artificial Sequence
  chemically synthesized
ctcaaatatacttccctgtcag

SEQ ID NO: 1402994 - DNA, 22 bp, Artificial Sequence
  chemically synthesized
aaatatacttccctgtcagaaa

SEQ ID NO: 1402995 - DNA, 22 bp, Artificial Sequence
  chemically synthesized
tatataatcatttttttctgac

SEQ ID NO: 1402996 - DNA, 22 bp, Artificial Sequence
  chemically synthesized
atatataatcatttttttctga

SEQ ID NO: 1402997 - DNA, 22 bp, Artificial Sequence
  chemically synthesized
tatatataatcatttttttctg

SEQ ID NO: 1402998 - DNA, 22 bp, Artificial Sequence
  chemically synthesized
attttatatataatcatttttt

SEQ ID NO: 1402999 - DNA, 22 bp, Artificial Sequence
  chemically synthesized
aattttatatataatcattttt

SEQ ID NO: 1403000 - DNA, 22 bp, Artificial Sequence
  chemically synthesized
ccctgtcagaaaaaaatgatta

SEQ ID NO: 1403001 - DNA, 22 bp, Artificial Sequence
  chemically synthesized
cctgtcagaaaaaaatgattat

SEQ ID NO: 1403002 - DNA, 22 bp, Artificial Sequence
  chemically synthesized
atttaattttatatataatcat

SEQ ID NO: 1403003 - DNA, 22 bp, Artificial Sequence
  chemically synthesized
tcagaaaaaaatgattatatat

SEQ ID NO: 1403004 - DNA, 22 bp, Artificial Sequence
  chemically synthesized
ctcatttaattttatatataat

SEQ ID NO: 1403005 - DNA, 22 bp, Artificial Sequence
  chemically synthesized
cctcatttaattttatatataa

SEQ ID NO: 1403006 - DNA, 22 bp, Artificial Sequence
  chemically synthesized
tcctcatttaattttatatata

SEQ ID NO: 1403007 - DNA, 22 bp, Artificial Sequence
  chemically synthesized
atagttttcctcatttaatttt

SEQ ID NO: 1403008 - DNA, 22 bp, Artificial Sequence
  chemically synthesized
ttaatagttttcctcatttaat

SEQ ID NO: 1403009 - DNA, 22 bp, Artificial Sequence
  chemically synthesized
ttattaatagttttcctcattt

SEQ ID NO: 1403010 - DNA, 22 bp, Artificial Sequence
  chemically synthesized
tatataaaattaaatgaggaaa

SEQ ID NO: 1403011 - DNA, 22 bp, Artificial Sequence
  chemically synthesized
attattaatagttttcctcatt

SEQ ID NO: 1403012 - DNA, 22 bp, Artificial Sequence
  chemically synthesized
tattattaatagttttcctcat

SEQ ID NO: 1403013 - DNA, 22 bp, Artificial Sequence
  chemically synthesized
aatgaggaaaactattaataat

SEQ ID NO: 1403014 - DNA, 22 bp, Artificial Sequence
  chemically synthesized
ttaataataaaatatcatgttg

SEQ ID NO: 1403015 - DNA, 22 bp, Artificial Sequence
  chemically synthesized
ataataaaatatcatgttgtct

SEQ ID NO: 1403016 - DNA, 22 bp, Artificial Sequence
  chemically synthesized
gtaaaaggcaacccaagacaac

SEQ ID NO: 1403017 - DNA, 22 bp, Artificial Sequence
  chemically synthesized
tggtaaaaggcaacccaagaca

SEQ ID NO: 1403018 - DNA, 22 bp, Artificial Sequence
  chemically synthesized
ctggtaaaaggcaacccaagac

SEQ ID NO: 1403019 - DNA, 22 bp, Artificial Sequence
  chemically synthesized
cttctggtaaaaggcaacccaa

SEQ ID NO: 1403020 - DNA, 22 bp, Artificial Sequence
  chemically synthesized
agggtctacttctggtaaaagg

SEQ ID NO: 1403021 - DNA, 22 bp, Artificial Sequence
  chemically synthesized
tcttgggttgccttttaccaga

SEQ ID NO: 1403022 - DNA, 22 bp, Artificial Sequence
  chemically synthesized
ctcagggtctacttctggtaaa

SEQ ID NO: 1403023 - DNA, 22 bp, Artificial Sequence
  chemically synthesized
gctcagggtctacttctggtaa

SEQ ID NO: 1403024 - DNA, 22 bp, Artificial Sequence
  chemically synthesized
gggttgccttttaccagaagta

SEQ ID NO: 1403025 - DNA, 22 bp, Artificial Sequence
  chemically synthesized
ggttgccttttaccagaagtag

SEQ ID NO: 1403026 - DNA, 22 bp, Artificial Sequence
  chemically synthesized
ccttttaccagaagtagaccct

SEQ ID NO: 1403027 - DNA, 22 bp, Artificial Sequence
  chemically synthesized
aaataatttgctcagggtctac

SEQ ID NO: 1403028 - DNA, 22 bp, Artificial Sequence
  chemically synthesized
ttaccagaagtagaccctgagc

SEQ ID NO: 1403029 - DNA, 22 bp, Artificial Sequence
  chemically synthesized
taccagaagtagaccctgagca

SEQ ID NO: 1403030 - DNA, 22 bp, Artificial Sequence
  chemically synthesized
accagaagtagaccctgagcaa

SEQ ID NO: 1403031 - DNA, 22 bp, Artificial Sequence
  chemically synthesized
ccagaagtagaccctgagcaaa

SEQ ID NO: 1403032 - DNA, 22 bp, Artificial Sequence
  chemically synthesized
gcactcaaataatttgctcagg

SEQ ID NO: 1403033 - DNA, 22 bp, Artificial Sequence
  chemically synthesized
ctggcactcaaataatttgctc

SEQ ID NO: 1403034 - DNA, 22 bp, Artificial Sequence
  chemically synthesized
cgaaataagttgctggcactca

SEQ ID NO: 1403035 - DNA, 22 bp, Artificial Sequence
  chemically synthesized
agcaaattatttgagtgccagc

SEQ ID NO: 1403036 - DNA, 22 bp, Artificial Sequence
  chemically synthesized
tttgagtgccagcaacttattt

SEQ ID NO: 1403037 - DNA, 22 bp, Artificial Sequence
  chemically synthesized
ggatcacctccgaaataagttg

SEQ ID NO: 1403038 - DNA, 22 bp, Artificial Sequence
  chemically synthesized
gagtgccagcaacttatttcgg

SEQ ID NO: 1403039 - DNA, 22 bp, Artificial Sequence
  chemically synthesized
ctgggatcacctccgaaataag

SEQ ID NO: 1403040 - DNA, 22 bp, Artificial Sequence
  chemically synthesized
agtgccagcaacttatttcgga

SEQ ID NO: 1403041 - DNA, 22 bp, Artificial Sequence
  chemically synthesized
cctgggatcacctccgaaataa

SEQ ID NO: 1403042 - DNA, 22 bp, Artificial Sequence
  chemically synthesized
tgcttcctgggatcacctccga

SEQ ID NO: 1403043 - DNA, 22 bp, Artificial Sequence
  chemically synthesized
ctgtgcttcctgggatcacctc

SEQ ID NO: 1403044 - DNA, 22 bp, Artificial Sequence
  chemically synthesized
gctgtgcttcctgggatcacct

SEQ ID NO: 1403045 - DNA, 22 bp, Artificial Sequence
  chemically synthesized
tgctgtgcttcctgggatcacc

SEQ ID NO: 1403046 - DNA, 22 bp, Artificial Sequence
  chemically synthesized
tttgctgtgcttcctgggatca

SEQ ID NO: 1403047 - DNA, 22 bp, Artificial Sequence
  chemically synthesized
ctttgctgtgcttcctgggatc

SEQ ID NO: 1403048 - DNA, 22 bp, Artificial Sequence
  chemically synthesized
atttcggaggtgatcccaggaa

SEQ ID NO: 1403049 - DNA, 22 bp, Artificial Sequence
  chemically synthesized
tttcggaggtgatcccaggaag

SEQ ID NO: 1403050 - DNA, 22 bp, Artificial Sequence
  chemically synthesized
acttctttgctgtgcttcctgg

SEQ ID NO: 1403051 - DNA, 22 bp, Artificial Sequence
  chemically synthesized
cggaggtgatcccaggaagcac

SEQ ID NO: 1403052 - DNA, 22 bp, Artificial Sequence
  chemically synthesized
ggaggtgatcccaggaagcaca

SEQ ID NO: 1403053 - DNA, 22 bp, Artificial Sequence
  chemically synthesized
actcacttctttgctgtgcttc

SEQ ID NO: 1403054 - DNA, 22 bp, Artificial Sequence
  chemically synthesized
cgtctcactcacttctttgctg

SEQ ID NO: 1403055 - DNA, 22 bp, Artificial Sequence
  chemically synthesized
tccgtctcactcacttctttgc

SEQ ID NO: 1403056 - DNA, 22 bp, Artificial Sequence
  chemically synthesized
ctccgtctcactcacttctttg

SEQ ID NO: 1403057 - DNA, 22 bp, Artificial Sequence
  chemically synthesized
tctccgtctcactcacttcttt

SEQ ID NO: 1403058 - DNA, 22 bp, Artificial Sequence
  chemically synthesized
ttctccgtctcactcacttctt

SEQ ID NO: 1403059 - DNA, 22 bp, Artificial Sequence
  chemically synthesized
ttttctccgtctcactcacttc

SEQ ID NO: 1403060 - DNA, 22 bp, Artificial Sequence
  chemically synthesized
gtgttcttttctccgtctcact

SEQ ID NO: 1403061 - DNA, 22 bp, Artificial Sequence
  chemically synthesized
tactggtgttcttttctccgtc

SEQ ID NO: 1403062 - DNA, 22 bp, Artificial Sequence
  chemically synthesized
acactgtactggtgttcttttc

SEQ ID NO: 1403063 - DNA, 22 bp, Artificial Sequence
  chemically synthesized
atgaaactcacactgtactggt

SEQ ID NO: 1403064 - DNA, 22 bp, Artificial Sequence
  chemically synthesized
atgacatgctcatgaaactcac

SEQ ID NO: 1403065 - DNA, 22 bp, Artificial Sequence
  chemically synthesized
tcactgatgacatgctcatgaa

SEQ ID NO: 1403066 - DNA, 22 bp, Artificial Sequence
  chemically synthesized
atcactgatgacatgctcatga

SEQ ID NO: 1403067 - DNA, 22 bp, Artificial Sequence
  chemically synthesized
tatcactgatgacatgctcatg

SEQ ID NO: 1403068 - DNA, 22 bp, Artificial Sequence
  chemically synthesized
attttatcactgatgacatgct

SEQ ID NO: 1403069 - DNA, 22 bp, Artificial Sequence
  chemically synthesized
aacctcattttatcactgatga

SEQ ID NO: 1403070 - DNA, 22 bp, Artificial Sequence
  chemically synthesized
catgagcatgtcatcagtgata

SEQ ID NO: 1403071 - DNA, 22 bp, Artificial Sequence
  chemically synthesized
atgagcatgtcatcagtgataa

SEQ ID NO: 1403072 - DNA, 22 bp, Artificial Sequence
  chemically synthesized
aagtggtactgaacctcatttt

SEQ ID NO: 1403073 - DNA, 22 bp, Artificial Sequence
  chemically synthesized
gtggtctcaagtggtactgaac

SEQ ID NO: 1403074 - DNA, 22 bp, Artificial Sequence
  chemically synthesized
ctagtggtctcaagtggtactg

SEQ ID NO: 1403075 - DNA, 22 bp, Artificial Sequence
  chemically synthesized
tcctagtggtctcaagtggtac

SEQ ID NO: 1403076 - DNA, 22 bp, Artificial Sequence
  chemically synthesized
agtaccacttgagaccactagg

SEQ ID NO: 1403077 - DNA, 22 bp, Artificial Sequence
  chemically synthesized
aggtgagacaaatcattctcct

SEQ ID NO: 1403078 - DNA, 22 bp, Artificial Sequence
  chemically synthesized
tcaggtgagacaaatcattctc

SEQ ID NO: 1403079 - DNA, 22 bp, Artificial Sequence
  chemically synthesized
gagaccactaggagaatgattt

SEQ ID NO: 1403080 - DNA, 22 bp, Artificial Sequence
  chemically synthesized
ctcaggtgagacaaatcattct

SEQ ID NO: 1403081 - DNA, 22 bp, Artificial Sequence
  chemically synthesized
agaccactaggagaatgatttg

SEQ ID NO: 1403082 - DNA, 22 bp, Artificial Sequence
  chemically synthesized
cttctcaggtgagacaaatcat

SEQ ID NO: 1403083 - DNA, 22 bp, Artificial Sequence
  chemically synthesized
gcttctcaggtgagacaaatca

SEQ ID NO: 1403084 - DNA, 22 bp, Artificial Sequence
  chemically synthesized
ttgcttctcaggtgagacaaat

SEQ ID NO: 1403085 - DNA, 22 bp, Artificial Sequence
  chemically synthesized
cttgcttctcaggtgagacaaa

SEQ ID NO: 1403086 - DNA, 22 bp, Artificial Sequence
  chemically synthesized
tcttgcttctcaggtgagacaa

SEQ ID NO: 1403087 - DNA, 22 bp, Artificial Sequence
  chemically synthesized
ggagaatgatttgtctcacctg

SEQ ID NO: 1403088 - DNA, 22 bp, Artificial Sequence
  chemically synthesized
cctttcttgcttctcaggtgag

SEQ ID NO: 1403089 - DNA, 22 bp, Artificial Sequence
  chemically synthesized
ccctacctttcttgcttctcag

SEQ ID NO: 1403090 - DNA, 22 bp, Artificial Sequence
  chemically synthesized
gtctcacctgagaagcaagaaa

SEQ ID NO: 1403091 - DNA, 22 bp, Artificial Sequence
  chemically synthesized
tctcacctgagaagcaagaaag

SEQ ID NO: 1403092 - DNA, 22 bp, Artificial Sequence
  chemically synthesized
tgggaactaccctacctttctt

SEQ ID NO: 1403093 - DNA, 22 bp, Artificial Sequence
  chemically synthesized
acctgagaagcaagaaaggtag

SEQ ID NO: 1403094 - DNA, 22 bp, Artificial Sequence
  chemically synthesized
gtgggaactaccctacctttct

SEQ ID NO: 1403095 - DNA, 22 bp, Artificial Sequence
  chemically synthesized
agaagcaagaaaggtagggtag

SEQ ID NO: 1403096 - DNA, 22 bp, Artificial Sequence
  chemically synthesized
cacatgggagtttgtgggaact

SEQ ID NO: 1403097 - DNA, 22 bp, Artificial Sequence
  chemically synthesized
acacattacacatgggagtttg

SEQ ID NO: 1403098 - DNA, 22 bp, Artificial Sequence
  chemically synthesized
aacacattacacatgggagttt

SEQ ID NO: 1403099 - DNA, 22 bp, Artificial Sequence
  chemically synthesized
ttaacacattacacatgggagt

SEQ ID NO: 1403100 - DNA, 22 bp, Artificial Sequence
  chemically synthesized
ttcttaacacattacacatggg

SEQ ID NO: 1403101 - DNA, 22 bp, Artificial Sequence
  chemically synthesized
ccacaaactcccatgtgtaatg

SEQ ID NO: 1403102 - DNA, 22 bp, Artificial Sequence
  chemically synthesized
ttgttcttaacacattacacat

SEQ ID NO: 1403103 - DNA, 22 bp, Artificial Sequence
  chemically synthesized
taatgattattgttcttaacac

SEQ ID NO: 1403104 - DNA, 22 bp, Artificial Sequence
  chemically synthesized
ccatgtgtaatgtgttaagaac

SEQ ID NO: 1403105 - DNA, 22 bp, Artificial Sequence
  chemically synthesized
attataatgattattgttctta

SEQ ID NO: 1403106 - DNA, 22 bp, Artificial Sequence
  chemically synthesized
aattataatgattattgttctt

SEQ ID NO: 1403107 - DNA, 22 bp, Artificial Sequence
  chemically synthesized
tttaattataatgattattgtt

SEQ ID NO: 1403108 - DNA, 22 bp, Artificial Sequence
  chemically synthesized
agaacaataatcattataatta

SEQ ID NO: 1403109 - DNA, 22 bp, Artificial Sequence
  chemically synthesized
ataatccattatttaattataa

SEQ ID NO: 1403110 - DNA, 22 bp, Artificial Sequence
  chemically synthesized
tgatagttaataatccattatt

SEQ ID NO: 1403111 - DNA, 22 bp, Artificial Sequence
  chemically synthesized
taattaaataatggattattaa

SEQ ID NO: 1403112 - DNA, 22 bp, Artificial Sequence
  chemically synthesized
caatgttgtgatagttaataat

SEQ ID NO: 1403113 - DNA, 22 bp, Artificial Sequence
  chemically synthesized
aataatggattattaactatca

SEQ ID NO: 1403114 - DNA, 22 bp, Artificial Sequence
  chemically synthesized
atagaactacaatgttgtgata

SEQ ID NO: 1403115 - DNA, 22 bp, Artificial Sequence
  chemically synthesized
agactaatagaactacaatgtt

SEQ ID NO: 1403116 - DNA, 22 bp, Artificial Sequence
  chemically synthesized
ttaactatcacaacattgtagt

SEQ ID NO: 1403117 - DNA, 22 bp, Artificial Sequence
  chemically synthesized
actatcacaacattgtagttct

SEQ ID NO: 1403118 - DNA, 22 bp, Artificial Sequence
  chemically synthesized
aggctcagactaatagaactac

SEQ ID NO: 1403119 - DNA, 22 bp, Artificial Sequence
  chemically synthesized
tcacaacattgtagttctatta

SEQ ID NO: 1403120 - DNA, 22 bp, Artificial Sequence
  chemically synthesized
tatgcattaaggctcagactaa

SEQ ID NO: 1403121 - DNA, 22 bp, Artificial Sequence
  chemically synthesized
tagttctattagtctgagcctt

SEQ ID NO: 1403122 - DNA, 22 bp, Artificial Sequence
  chemically synthesized
tattagtctgagccttaatgca

SEQ ID NO: 1403123 - DNA, 22 bp, Artificial Sequence
  chemically synthesized
caaaaatctgtatgcattaagg

SEQ ID NO: 1403124 - DNA, 22 bp, Artificial Sequence
  chemically synthesized
gcaaaaatctgtatgcattaag

SEQ ID NO: 1403125 - DNA, 22 bp, Artificial Sequence
  chemically synthesized
ttagtctgagccttaatgcata

SEQ ID NO: 1403126 - DNA, 22 bp, Artificial Sequence
  chemically synthesized
gtctgagccttaatgcatacag

SEQ ID NO: 1403127 - DNA, 22 bp, Artificial Sequence
  chemically synthesized
agccttaatgcatacagatttt

SEQ ID NO: 1403128 - DNA, 22 bp, Artificial Sequence
  chemically synthesized
catgaagtttgcaaaaatctgt

SEQ ID NO: 1403129 - DNA, 22 bp, Artificial Sequence
  chemically synthesized
ccatgaagtttgcaaaaatctg

SEQ ID NO: 1403130 - DNA, 22 bp, Artificial Sequence
  chemically synthesized
aatgcatacagatttttgcaaa

SEQ ID NO: 1403131 - DNA, 22 bp, Artificial Sequence
  chemically synthesized
atgcatacagatttttgcaaac

SEQ ID NO: 1403132 - DNA, 22 bp, Artificial Sequence
  chemically synthesized
aaataaaatggaaacttccatg

SEQ ID NO: 1403133 - DNA, 22 bp, Artificial Sequence
  chemically synthesized
caaataaaatggaaacttccat

SEQ ID NO: 1403134 - DNA, 22 bp, Artificial Sequence
  chemically synthesized
ttgcaaacttcatggaagtttc

SEQ ID NO: 1403135 - DNA, 22 bp, Artificial Sequence
  chemically synthesized
tgcaaacttcatggaagtttcc

SEQ ID NO: 1403136 - DNA, 22 bp, Artificial Sequence
  chemically synthesized
gcaaacttcatggaagtttcca

SEQ ID NO: 1403137 - DNA, 22 bp, Artificial Sequence
  chemically synthesized
caaacttcatggaagtttccat

SEQ ID NO: 1403138 - DNA, 22 bp, Artificial Sequence
  chemically synthesized
atttcaaataaaatggaaactt

SEQ ID NO: 1403139 - DNA, 22 bp, Artificial Sequence
  chemically synthesized
catggaagtttccattttattt

SEQ ID NO: 1403140 - DNA, 22 bp, Artificial Sequence
  chemically synthesized
atggaagtttccattttatttg

SEQ ID NO: 1403141 - DNA, 22 bp, Artificial Sequence
  chemically synthesized
atcaaaaactaatttcaaataa

SEQ ID NO: 1403142 - DNA, 22 bp, Artificial Sequence
  chemically synthesized
aatcaaaaactaatttcaaata

SEQ ID NO: 1403143 - DNA, 22 bp, Artificial Sequence
  chemically synthesized
taatcaaaaactaatttcaaat

SEQ ID NO: 1403144 - DNA, 22 bp, Artificial Sequence
  chemically synthesized
ttaatcaaaaactaatttcaaa

SEQ ID NO: 1403145 - DNA, 22 bp, Artificial Sequence
  chemically synthesized
tttttaatcaaaaactaatttc

SEQ ID NO: 1403146 - DNA, 22 bp, Artificial Sequence
  chemically synthesized
ccattttatttgaaattagttt

SEQ ID NO: 1403147 - DNA, 22 bp, Artificial Sequence
  chemically synthesized
cattttatttgaaattagtttt

SEQ ID NO: 1403148 - DNA, 22 bp, Artificial Sequence
  chemically synthesized
cattatttttaatcaaaaacta

SEQ ID NO: 1403149 - DNA, 22 bp, Artificial Sequence
  chemically synthesized
tatttgaaattagtttttgatt

SEQ ID NO: 1403150 - DNA, 22 bp, Artificial Sequence
  chemically synthesized
atttgaaattagtttttgatta

SEQ ID NO: 1403151 - DNA, 22 bp, Artificial Sequence
  chemically synthesized
tttgaaattagtttttgattaa

SEQ ID NO: 1403152 - DNA, 22 bp, Artificial Sequence
  chemically synthesized
gaaattagtttttgattaaaaa

SEQ ID NO: 1403153 - DNA, 22 bp, Artificial Sequence
  chemically synthesized
aaattagtttttgattaaaaat

SEQ ID NO: 1403154 - DNA, 22 bp, Artificial Sequence
  chemically synthesized
aaggagcgttccattattttta

SEQ ID NO: 1403155 - DNA, 22 bp, Artificial Sequence
  chemically synthesized
gtttttgattaaaaataatgga

SEQ ID NO: 1403156 - DNA, 22 bp, Artificial Sequence
  chemically synthesized
attgaaggagcgttccattatt

SEQ ID NO: 1403157 - DNA, 22 bp, Artificial Sequence
  chemically synthesized
ttgattaaaaataatggaacgc

SEQ ID NO: 1403158 - DNA, 22 bp, Artificial Sequence
  chemically synthesized
tgattaaaaataatggaacgct

SEQ ID NO: 1403159 - DNA, 22 bp, Artificial Sequence
  chemically synthesized
attgattgaaggagcgttccat

SEQ ID NO: 1403160 - DNA, 22 bp, Artificial Sequence
  chemically synthesized
gattaaaaataatggaacgctc

SEQ ID NO: 1403161 - DNA, 22 bp, Artificial Sequence
  chemically synthesized
aattgattgaaggagcgttcca

SEQ ID NO: 1403162 - DNA, 22 bp, Artificial Sequence
  chemically synthesized
attaaaaataatggaacgctcc

SEQ ID NO: 1403163 - DNA, 22 bp, Artificial Sequence
  chemically synthesized
taattgattgaaggagcgttcc

SEQ ID NO: 1403164 - DNA, 22 bp, Artificial Sequence
  chemically synthesized
ttaattgattgaaggagcgttc

SEQ ID NO: 1403165 - DNA, 22 bp, Artificial Sequence
  chemically synthesized
aaaataatggaacgctccttca

SEQ ID NO: 1403166 - DNA, 22 bp, Artificial Sequence
  chemically synthesized
atatttttaattgattgaagga

SEQ ID NO: 1403167 - DNA, 22 bp, Artificial Sequence
  chemically synthesized
ctgatatttttaattgattgaa

SEQ ID NO: 1403168 - DNA, 22 bp, Artificial Sequence
  chemically synthesized
cttcaatcaattaaaaatatca

SEQ ID NO: 1403169 - DNA, 22 bp, Artificial Sequence
  chemically synthesized
caatcaattaaaaatatcagca

SEQ ID NO: 1403170 - DNA, 22 bp, Artificial Sequence
  chemically synthesized
aatcaattaaaaatatcagcag

SEQ ID NO: 1403171 - DNA, 22 bp, Artificial Sequence
  chemically synthesized
caagcagatggatctgctgata

SEQ ID NO: 1403172 - DNA, 22 bp, Artificial Sequence
  chemically synthesized
ccaagcagatggatctgctgat

SEQ ID NO: 1403173 - DNA, 22 bp, Artificial Sequence
  chemically synthesized
tccaagcagatggatctgctga

SEQ ID NO: 1403174 - DNA, 22 bp, Artificial Sequence
  chemically synthesized
aaaatatcagcagatccatctg

SEQ ID NO: 1403175 - DNA, 22 bp, Artificial Sequence
  chemically synthesized
cttggaaaatgattcttcctga

SEQ ID NO: 1403176 - DNA, 22 bp, Artificial Sequence
  chemically synthesized
ggaaaatgattcttcctgatgc

SEQ ID NO: 1403177 - DNA, 22 bp, Artificial Sequence
  chemically synthesized
gaaaatgattcttcctgatgct

SEQ ID NO: 1403178 - DNA, 22 bp, Artificial Sequence
  chemically synthesized
ttcctgatgctggcttccatcc

SEQ ID NO: 1403179 - DNA, 22 bp, Artificial Sequence
  chemically synthesized
cctgatgctggcttccatccta

SEQ ID NO: 1403180 - DNA, 22 bp, Artificial Sequence
  chemically synthesized
ctgatgctggcttccatcctac

SEQ ID NO: 1403181 - DNA, 22 bp, Artificial Sequence
  chemically synthesized
atgctggcttccatcctactgg

SEQ ID NO: 1403182 - DNA, 22 bp, Artificial Sequence
  chemically synthesized
gcttccatcctactggttgaca

SEQ ID NO: 1403183 - DNA, 22 bp, Artificial Sequence
  chemically synthesized
acccaacgtaatgatgtcaacc

SEQ ID NO: 1403184 - DNA, 22 bp, Artificial Sequence
  chemically synthesized
aacccaacgtaatgatgtcaac

SEQ ID NO: 1403185 - DNA, 22 bp, Artificial Sequence
  chemically synthesized
ccatcctactggttgacatcat

SEQ ID NO: 1403186 - DNA, 22 bp, Artificial Sequence
  chemically synthesized
catcctactggttgacatcatt

SEQ ID NO: 1403187 - DNA, 22 bp, Artificial Sequence
  chemically synthesized
cttaacccaacgtaatgatgtc

SEQ ID NO: 1403188 - DNA, 22 bp, Artificial Sequence
  chemically synthesized
ctggttgacatcattacgttgg

SEQ ID NO: 1403189 - DNA, 22 bp, Artificial Sequence
  chemically synthesized
gttgacatcattacgttgggtt

SEQ ID NO: 1403190 - DNA, 22 bp, Artificial Sequence
  chemically synthesized
cccatgtcactgcttaacccaa

SEQ ID NO: 1403191 - DNA, 22 bp, Artificial Sequence
  chemically synthesized
acatcattacgttgggttaagc

SEQ ID NO: 1403192 - DNA, 22 bp, Artificial Sequence
  chemically synthesized
cgttgggttaagcagtgacatg

SEQ ID NO: 1403193 - DNA, 22 bp, Artificial Sequence
  chemically synthesized
agaacaattacccatgtcactg

SEQ ID NO: 1403194 - DNA, 22 bp, Artificial Sequence
  chemically synthesized
aagaacaattacccatgtcact

SEQ ID NO: 1403195 - DNA, 22 bp, Artificial Sequence
  chemically synthesized
taagaacaattacccatgtcac

SEQ ID NO: 1403196 - DNA, 22 bp, Artificial Sequence
  chemically synthesized
ggttaagcagtgacatgggtaa

SEQ ID NO: 1403197 - DNA, 22 bp, Artificial Sequence
  chemically synthesized
agcagtgacatgggtaattgtt

SEQ ID NO: 1403198 - DNA, 22 bp, Artificial Sequence
  chemically synthesized
atcacattttaagaacaattac

SEQ ID NO: 1403199 - DNA, 22 bp, Artificial Sequence
  chemically synthesized
ttcttaaaatgtgatcaattct

SEQ ID NO: 1403200 - DNA, 22 bp, Artificial Sequence
  chemically synthesized
ttaaaatgtgatcaattctctt

SEQ ID NO: 1403201 - DNA, 22 bp, Artificial Sequence
  chemically synthesized
aaaatgtgatcaattctcttat

SEQ ID NO: 1403202 - DNA, 22 bp, Artificial Sequence
  chemically synthesized
aaatgtgatcaattctcttatt

SEQ ID NO: 1403203 - DNA, 22 bp, Artificial Sequence
  chemically synthesized
tcttattctcccacacactttt

SEQ ID NO: 1403204 - DNA, 22 bp, Artificial Sequence
  chemically synthesized
ttattctcccacacacttttga

SEQ ID NO: 1403205 - DNA, 22 bp, Artificial Sequence
  chemically synthesized
attctcccacacacttttgacc

SEQ ID NO: 1403206 - DNA, 22 bp, Artificial Sequence
  chemically synthesized
ttctcccacacacttttgacct

SEQ ID NO: 1403207 - DNA, 22 bp, Artificial Sequence
  chemically synthesized
tcccacacacttttgacctgca

SEQ ID NO: 1403208 - DNA, 22 bp, Artificial Sequence
  chemically synthesized
ccacacacttttgacctgcatt

SEQ ID NO: 1403209 - DNA, 22 bp, Artificial Sequence
  chemically synthesized
atataacaaagatagagaataa

SEQ ID NO: 1403210 - DNA, 22 bp, Artificial Sequence
  chemically synthesized
ttgacctgcatttattctctat

SEQ ID NO: 1403211 - DNA, 22 bp, Artificial Sequence
  chemically synthesized
aatataacaaagatagagaata

SEQ ID NO: 1403212 - DNA, 22 bp, Artificial Sequence
  chemically synthesized
tgacctgcatttattctctatc

SEQ ID NO: 1403213 - DNA, 22 bp, Artificial Sequence
  chemically synthesized
taatataacaaagatagagaat

SEQ ID NO: 1403214 - DNA, 22 bp, Artificial Sequence
  chemically synthesized
gacctgcatttattctctatct

SEQ ID NO: 1403215 - DNA, 22 bp, Artificial Sequence
  chemically synthesized
acctgcatttattctctatctt

SEQ ID NO: 1403216 - DNA, 22 bp, Artificial Sequence
  chemically synthesized
catttattctctatctttgtta

SEQ ID NO: 1403217 - DNA, 22 bp, Artificial Sequence
  chemically synthesized
acaatctttaatataacaaaga

SEQ ID NO: 1403218 - DNA, 22 bp, Artificial Sequence
  chemically synthesized
attctctatctttgttatatta

SEQ ID NO: 1403219 - DNA, 22 bp, Artificial Sequence
  chemically synthesized
ttctctatctttgttatattaa

SEQ ID NO: 1403220 - DNA, 22 bp, Artificial Sequence
  chemically synthesized
tctatctttgttatattaaaga

SEQ ID NO: 1403221 - DNA, 22 bp, Artificial Sequence
  chemically synthesized
tatctttgttatattaaagatt

SEQ ID NO: 1403222 - DNA, 22 bp, Artificial Sequence
  chemically synthesized
tctttgttatattaaagattgt

SEQ ID NO: 1403223 - DNA, 22 bp, Artificial Sequence
  chemically synthesized
agggaaaacattgacaatcttt

SEQ ID NO: 1403224 - DNA, 22 bp, Artificial Sequence
  chemically synthesized
tgttatattaaagattgtcaat

SEQ ID NO: 1403225 - DNA, 22 bp, Artificial Sequence
  chemically synthesized
gttatattaaagattgtcaatg

SEQ ID NO: 1403226 - DNA, 22 bp, Artificial Sequence
  chemically synthesized
ttatattaaagattgtcaatgt

SEQ ID NO: 1403227 - DNA, 22 bp, Artificial Sequence
  chemically synthesized
tattaaagattgtcaatgtttt

SEQ ID NO: 1403228 - DNA, 22 bp, Artificial Sequence
  chemically synthesized
tcaaattaagggaaaacattga

SEQ ID NO: 1403229 - DNA, 22 bp, Artificial Sequence
  chemically synthesized
aagattgtcaatgttttccctt

SEQ ID NO: 1403230 - DNA, 22 bp, Artificial Sequence
  chemically synthesized
tgctgtcaaattaagggaaaac

SEQ ID NO: 1403231 - DNA, 22 bp, Artificial Sequence
  chemically synthesized
gtgctgtcaaattaagggaaaa

SEQ ID NO: 1403232 - DNA, 22 bp, Artificial Sequence
  chemically synthesized
atttgtgctgtcaaattaaggg

SEQ ID NO: 1403233 - DNA, 22 bp, Artificial Sequence
  chemically synthesized
tcaatgttttcccttaatttga

SEQ ID NO: 1403234 - DNA, 22 bp, Artificial Sequence
  chemically synthesized
atattcatttgtgctgtcaaat

SEQ ID NO: 1403235 - DNA, 22 bp, Artificial Sequence
  chemically synthesized
tcccttaatttgacagcacaaa

SEQ ID NO: 1403236 - DNA, 22 bp, Artificial Sequence
  chemically synthesized
cccttaatttgacagcacaaat

SEQ ID NO: 1403237 - DNA, 22 bp, Artificial Sequence
  chemically synthesized
ccttaatttgacagcacaaatg

SEQ ID NO: 1403238 - DNA, 22 bp, Artificial Sequence
  chemically synthesized
aatttgacagcacaaatgaata

SEQ ID NO: 1403239 - DNA, 22 bp, Artificial Sequence
  chemically synthesized
atttgacagcacaaatgaatat

SEQ ID NO: 1403240 - DNA, 22 bp, Artificial Sequence
  chemically synthesized
gacagcacaaatgaatatcaac

SEQ ID NO: 1403241 - DNA, 22 bp, Artificial Sequence
  chemically synthesized
acagcacaaatgaatatcaaca

SEQ ID NO: 1403242 - DNA, 22 bp, Artificial Sequence
  chemically synthesized
aggcaatagtgccatgttgata

SEQ ID NO: 1403243 - DNA, 22 bp, Artificial Sequence
  chemically synthesized
gaggcaatagtgccatgttgat

SEQ ID NO: 1403244 - DNA, 22 bp, Artificial Sequence
  chemically synthesized
tgaggcaatagtgccatgttga

SEQ ID NO: 1403245 - DNA, 22 bp, Artificial Sequence
  chemically synthesized
cattttgaggcaatagtgccat

SEQ ID NO: 1403246 - DNA, 22 bp, Artificial Sequence
  chemically synthesized
ccattttgaggcaatagtgcca

SEQ ID NO: 1403247 - DNA, 22 bp, Artificial Sequence
  chemically synthesized
tccattttgaggcaatagtgcc

SEQ ID NO: 1403248 - DNA, 22 bp, Artificial Sequence
  chemically synthesized
ttccattttgaggcaatagtgc

SEQ ID NO: 1403249 - DNA, 22 bp, Artificial Sequence
  chemically synthesized
ccttttccattttgaggcaata

SEQ ID NO: 1403250 - DNA, 22 bp, Artificial Sequence
  chemically synthesized
gccttttccattttgaggcaat

SEQ ID NO: 1403251 - DNA, 22 bp, Artificial Sequence
  chemically synthesized
tgccttttccattttgaggcaa

SEQ ID NO: 1403252 - DNA, 22 bp, Artificial Sequence
  chemically synthesized
ttgccttttccattttgaggca

SEQ ID NO: 1403253 - DNA, 22 bp, Artificial Sequence
  chemically synthesized
tttgccttttccattttgaggc

SEQ ID NO: 1403254 - DNA, 22 bp, Artificial Sequence
  chemically synthesized
ttttgccttttccattttgagg

SEQ ID NO: 1403255 - DNA, 22 bp, Artificial Sequence
  chemically synthesized
cttttttgccttttccattttg

SEQ ID NO: 1403256 - DNA, 22 bp, Artificial Sequence
  chemically synthesized
ttgcctcaaaatggaaaaggca

SEQ ID NO: 1403257 - DNA, 22 bp, Artificial Sequence
  chemically synthesized
atgattgcttttttgccttttc

SEQ ID NO: 1403258 - DNA, 22 bp, Artificial Sequence
  chemically synthesized
cctcaaaatggaaaaggcaaaa

SEQ ID NO: 1403259 - DNA, 22 bp, Artificial Sequence
  chemically synthesized
aaaatggaaaaggcaaaaaagc

SEQ ID NO: 1403260 - DNA, 22 bp, Artificial Sequence
  chemically synthesized
aagaaacatgtgattcatgatt

SEQ ID NO: 1403261 - DNA, 22 bp, Artificial Sequence
  chemically synthesized
tatattaaagaaacatgtgatt

SEQ ID NO: 1403262 - DNA, 22 bp, Artificial Sequence
  chemically synthesized
taactgtatattaaagaaacat

SEQ ID NO: 1403263 - DNA, 22 bp, Artificial Sequence
  chemically synthesized
aaaatctgtaactgtatattaa

SEQ ID NO: 1403264 - DNA, 22 bp, Artificial Sequence
  chemically synthesized
ctttaatatacagttacagatt

SEQ ID NO: 1403265 - DNA, 22 bp, Artificial Sequence
  chemically synthesized
tttaatatacagttacagattt

SEQ ID NO: 1403266 - DNA, 22 bp, Artificial Sequence
  chemically synthesized
taatatacagttacagattttg

SEQ ID NO: 1403267 - DNA, 22 bp, Artificial Sequence
  chemically synthesized
aatatacagttacagattttga

SEQ ID NO: 1403268 - DNA, 22 bp, Artificial Sequence
  chemically synthesized
atatacagttacagattttgag

SEQ ID NO: 1403269 - DNA, 22 bp, Artificial Sequence
  chemically synthesized
cagattttgagttcatttccac

SEQ ID NO: 1403270 - DNA, 22 bp, Artificial Sequence
  chemically synthesized
tgagttcatttccacttctgat

SEQ ID NO: 1403271 - DNA, 22 bp, Artificial Sequence
  chemically synthesized
gagttcatttccacttctgatt

SEQ ID NO: 1403272 - DNA, 22 bp, Artificial Sequence
  chemically synthesized
agttcatttccacttctgattg

SEQ ID NO: 1403273 - DNA, 22 bp, Artificial Sequence
  chemically synthesized
atttccacttctgattgtggtt

SEQ ID NO: 1403274 - DNA, 22 bp, Artificial Sequence
  chemically synthesized
ccacttctgattgtggttatat

SEQ ID NO: 1403275 - DNA, 22 bp, Artificial Sequence
  chemically synthesized
cacttctgattgtggttatatc

SEQ ID NO: 1403276 - DNA, 22 bp, Artificial Sequence
  chemically synthesized
ctgattgtggttatatcttcca

SEQ ID NO: 1403277 - DNA, 22 bp, Artificial Sequence
  chemically synthesized
tgattgtggttatatcttccac

SEQ ID NO: 1403278 - DNA, 22 bp, Artificial Sequence
  chemically synthesized
attgtggttatatcttccacct

SEQ ID NO: 1403279 - DNA, 22 bp, Artificial Sequence
  chemically synthesized
tggttatatcttccaccttccc

SEQ ID NO: 1403280 - DNA, 22 bp, Artificial Sequence
  chemically synthesized
tatcttccaccttccctttcct

SEQ ID NO: 1403281 - DNA, 22 bp, Artificial Sequence
  chemically synthesized
atataaaacggcatgaaaggaa

SEQ ID NO: 1403282 - DNA, 22 bp, Artificial Sequence
  chemically synthesized
ccaccttccctttcctttcatg

SEQ ID NO: 1403283 - DNA, 22 bp, Artificial Sequence
  chemically synthesized
aatataaaacggcatgaaagga

SEQ ID NO: 1403284 - DNA, 22 bp, Artificial Sequence
  chemically synthesized
caccttccctttcctttcatgc

SEQ ID NO: 1403285 - DNA, 22 bp, Artificial Sequence
  chemically synthesized
taatataaaacggcatgaaagg

SEQ ID NO: 1403286 - DNA, 22 bp, Artificial Sequence
  chemically synthesized
acctttaatataaaacggcatg

SEQ ID NO: 1403287 - DNA, 22 bp, Artificial Sequence
  chemically synthesized
ccctttcctttcatgccgtttt

SEQ ID NO: 1403288 - DNA, 22 bp, Artificial Sequence
  chemically synthesized
cctttcctttcatgccgtttta

SEQ ID NO: 1403289 - DNA, 22 bp, Artificial Sequence
  chemically synthesized
tcctttcatgccgttttatatt

SEQ ID NO: 1403290 - DNA, 22 bp, Artificial Sequence
  chemically synthesized
cctttcatgccgttttatatta

SEQ ID NO: 1403291 - DNA, 22 bp, Artificial Sequence
  chemically synthesized
ctttcatgccgttttatattaa

SEQ ID NO: 1403292 - DNA, 22 bp, Artificial Sequence
  chemically synthesized
tcatgccgttttatattaaagg

SEQ ID NO: 1403293 - DNA, 22 bp, Artificial Sequence
  chemically synthesized
catgccgttttatattaaaggt

SEQ ID NO: 1403294 - DNA, 22 bp, Artificial Sequence
  chemically synthesized
atgccgttttatattaaaggtc

SEQ ID NO: 1403295 - DNA, 22 bp, Artificial Sequence
  chemically synthesized
ataaatgaacatattgaccttt

SEQ ID NO: 1403296 - DNA, 22 bp, Artificial Sequence
  chemically synthesized
tatattaaaggtcaatatgttc

SEQ ID NO: 1403297 - DNA, 22 bp, Artificial Sequence
  chemically synthesized
atattaaaggtcaatatgttca

SEQ ID NO: 1403298 - DNA, 22 bp, Artificial Sequence
  chemically synthesized
tattaaaggtcaatatgttcat

SEQ ID NO: 1403299 - DNA, 22 bp, Artificial Sequence
  chemically synthesized
cataattaataaatgaacatat

SEQ ID NO: 1403300 - DNA, 22 bp, Artificial Sequence
  chemically synthesized
ttgcataattaataaatgaaca

SEQ ID NO: 1403301 - DNA, 22 bp, Artificial Sequence
  chemically synthesized
gttgcataattaataaatgaac

SEQ ID NO: 1403302 - DNA, 22 bp, Artificial Sequence
  chemically synthesized
aaggtcaatatgttcatttatt

SEQ ID NO: 1403303 - DNA, 22 bp, Artificial Sequence
  chemically synthesized
taaacatgacacttgttgcata

SEQ ID NO: 1403304 - DNA, 22 bp, Artificial Sequence
  chemically synthesized
atttattaattatgcaacaagt

SEQ ID NO: 1403305 - DNA, 22 bp, Artificial Sequence
  chemically synthesized
attaattatgcaacaagtgtca

SEQ ID NO: 1403306 - DNA, 22 bp, Artificial Sequence
  chemically synthesized
ttaattatgcaacaagtgtcat

SEQ ID NO: 1403307 - DNA, 22 bp, Artificial Sequence
  chemically synthesized
caaacattgtaaacatgacact

SEQ ID NO: 1403308 - DNA, 22 bp, Artificial Sequence
  chemically synthesized
attatgcaacaagtgtcatgtt

SEQ ID NO: 1403309 - DNA, 22 bp, Artificial Sequence
  chemically synthesized
acaaacattgtaaacatgacac

SEQ ID NO: 1403310 - DNA, 22 bp, Artificial Sequence
  chemically synthesized
tgcaacaagtgtcatgtttaca

SEQ ID NO: 1403311 - DNA, 22 bp, Artificial Sequence
  chemically synthesized
catttacaaacattgtaaacat

SEQ ID NO: 1403312 - DNA, 22 bp, Artificial Sequence
  chemically synthesized
tgactacatttacaaacattgt

SEQ ID NO: 1403313 - DNA, 22 bp, Artificial Sequence
  chemically synthesized
acaatgtttgtaaatgtagtca

SEQ ID NO: 1403314 - DNA, 22 bp, Artificial Sequence
  chemically synthesized
caatgtttgtaaatgtagtcac

SEQ ID NO: 1403315 - DNA, 22 bp, Artificial Sequence
  chemically synthesized
agaaaatcaaatactgtgacta

SEQ ID NO: 1403316 - DNA, 22 bp, Artificial Sequence
  chemically synthesized
gtaaatgtagtcacagtatttg

SEQ ID NO: 1403317 - DNA, 22 bp, Artificial Sequence
  chemically synthesized
tattaagaaaatcaaatactgt

SEQ ID NO: 1403318 - DNA, 22 bp, Artificial Sequence
  chemically synthesized
taaatgtagtcacagtatttga

SEQ ID NO: 1403319 - DNA, 22 bp, Artificial Sequence
  chemically synthesized
ttatattaagaaaatcaaatac

SEQ ID NO: 1403320 - DNA, 22 bp, Artificial Sequence
  chemically synthesized
attatattaagaaaatcaaata

SEQ ID NO: 1403321 - DNA, 22 bp, Artificial Sequence
  chemically synthesized
tattatattaagaaaatcaaat

SEQ ID NO: 1403322 - DNA, 22 bp, Artificial Sequence
  chemically synthesized
gattttcttaatataataaaat

SEQ ID NO: 1403323 - DNA, 22 bp, Artificial Sequence
  chemically synthesized
attttcttaatataataaaatt

SEQ ID NO: 1403324 - DNA, 22 bp, Artificial Sequence
  chemically synthesized
tcttaatataataaaatttatc

SEQ ID NO: 1403325 - DNA, 22 bp, Artificial Sequence
  chemically synthesized
gccaaagcagaggataaatttt

SEQ ID NO: 1403326 - DNA, 22 bp, Artificial Sequence
  chemically synthesized
cttaatataataaaatttatcc

SEQ ID NO: 1403327 - DNA, 22 bp, Artificial Sequence
  chemically synthesized
ttaatataataaaatttatcct

SEQ ID NO: 1403328 - DNA, 22 bp, Artificial Sequence
  chemically synthesized
aatataataaaatttatcctct

SEQ ID NO: 1403329 - DNA, 22 bp, Artificial Sequence
  chemically synthesized
atataataaaatttatcctctg

SEQ ID NO: 1403330 - DNA, 22 bp, Artificial Sequence
  chemically synthesized
tattagccaaagcagaggataa

SEQ ID NO: 1403331 - DNA, 22 bp, Artificial Sequence
  chemically synthesized
atattagccaaagcagaggata

SEQ ID NO: 1403332 - DNA, 22 bp, Artificial Sequence
  chemically synthesized
tgggcttatattagccaaagca

SEQ ID NO: 1403333 - DNA, 22 bp, Artificial Sequence
  chemically synthesized
gtgggcttatattagccaaagc

SEQ ID NO: 1403334 - DNA, 22 bp, Artificial Sequence
  chemically synthesized
atcctctgctttggctaatata

SEQ ID NO: 1403335 - DNA, 22 bp, Artificial Sequence
  chemically synthesized
tcctctgctttggctaatataa

SEQ ID NO: 1403336 - DNA, 22 bp, Artificial Sequence
  chemically synthesized
tgctttggctaatataagccca

SEQ ID NO: 1403337 - DNA, 22 bp, Artificial Sequence
  chemically synthesized
ctttggctaatataagcccaca

SEQ ID NO: 1403338 - DNA, 22 bp, Artificial Sequence
  chemically synthesized
tggctaatataagcccacaaat

SEQ ID NO: 1403339 - DNA, 22 bp, Artificial Sequence
  chemically synthesized
ggctaatataagcccacaaatg

SEQ ID NO: 1403340 - DNA, 22 bp, Artificial Sequence
  chemically synthesized
gctaatataagcccacaaatga

SEQ ID NO: 1403341 - DNA, 22 bp, Artificial Sequence
  chemically synthesized
gaaaatgaaatgatcatttgtg

SEQ ID NO: 1403342 - DNA, 22 bp, Artificial Sequence
  chemically synthesized
atataagcccacaaatgatcat

SEQ ID NO: 1403343 - DNA, 22 bp, Artificial Sequence
  chemically synthesized
ttagaaaatgaaatgatcattt

SEQ ID NO: 1403344 - DNA, 22 bp, Artificial Sequence
  chemically synthesized
attagaaaatgaaatgatcatt

SEQ ID NO: 1403345 - DNA, 22 bp, Artificial Sequence
  chemically synthesized
atttattagaaaatgaaatgat

SEQ ID NO: 1403346 - DNA, 22 bp, Artificial Sequence
  chemically synthesized
aatttattagaaaatgaaatga

SEQ ID NO: 1403347 - DNA, 22 bp, Artificial Sequence
  chemically synthesized
taatttattagaaaatgaaatg

SEQ ID NO: 1403348 - DNA, 22 bp, Artificial Sequence
  chemically synthesized
ttaatttattagaaaatgaaat

SEQ ID NO: 1403349 - DNA, 22 bp, Artificial Sequence
  chemically synthesized
tacttttaatttattagaaaat

SEQ ID NO: 1403350 - DNA, 22 bp, Artificial Sequence
  chemically synthesized
tatacattatacttttaattta

SEQ ID NO: 1403351 - DNA, 22 bp, Artificial Sequence
  chemically synthesized
cattttctaataaattaaaagt

SEQ ID NO: 1403352 - DNA, 22 bp, Artificial Sequence
  chemically synthesized
attttctaataaattaaaagta

SEQ ID NO: 1403353 - DNA, 22 bp, Artificial Sequence
  chemically synthesized
tctaataaattaaaagtataat

SEQ ID NO: 1403354 - DNA, 22 bp, Artificial Sequence
  chemically synthesized
ctaataaattaaaagtataatg

SEQ ID NO: 1403355 - DNA, 22 bp, Artificial Sequence
  chemically synthesized
taataaattaaaagtataatgt

SEQ ID NO: 1403356 - DNA, 22 bp, Artificial Sequence
  chemically synthesized
ataaattaaaagtataatgtat

SEQ ID NO: 1403357 - DNA, 22 bp, Artificial Sequence
  chemically synthesized
acagaatccaattgtatacatt

SEQ ID NO: 1403358 - DNA, 22 bp, Artificial Sequence
  chemically synthesized
aaagtataatgtatacaattgg

SEQ ID NO: 1403359 - DNA, 22 bp, Artificial Sequence
  chemically synthesized
aaagacacatcaagcctgacag

SEQ ID NO: 1403360 - DNA, 22 bp, Artificial Sequence
  chemically synthesized
aaaagacacatcaagcctgaca

SEQ ID NO: 1403361 - DNA, 22 bp, Artificial Sequence
  chemically synthesized
tgtttaaaagacacatcaagcc

SEQ ID NO: 1403362 - DNA, 22 bp, Artificial Sequence
  chemically synthesized
gattctgtcaggcttgatgtgt

SEQ ID NO: 1403363 - DNA, 22 bp, Artificial Sequence
  chemically synthesized
tgtcaggcttgatgtgtctttt

SEQ ID NO: 1403364 - DNA, 22 bp, Artificial Sequence
  chemically synthesized
atgtgctgtgtttaaaagacac

SEQ ID NO: 1403365 - DNA, 22 bp, Artificial Sequence
  chemically synthesized
tcaggcttgatgtgtcttttaa

SEQ ID NO: 1403366 - DNA, 22 bp, Artificial Sequence
  chemically synthesized
aatgtgctgtgtttaaaagaca

SEQ ID NO: 1403367 - DNA, 22 bp, Artificial Sequence
  chemically synthesized
gatgtgtcttttaaacacagca

SEQ ID NO: 1403368 - DNA, 22 bp, Artificial Sequence
  chemically synthesized
atgtgtcttttaaacacagcac

SEQ ID NO: 1403369 - DNA, 22 bp, Artificial Sequence
  chemically synthesized
tacatagtggaatttaatgtgc

SEQ ID NO: 1403370 - DNA, 22 bp, Artificial Sequence
  chemically synthesized
atacatagtggaatttaatgtg

SEQ ID NO: 1403371 - DNA, 22 bp, Artificial Sequence
  chemically synthesized
tatacatagtggaatttaatgt

SEQ ID NO: 1403372 - DNA, 22 bp, Artificial Sequence
  chemically synthesized
ttaaacacagcacattaaattc

SEQ ID NO: 1403373 - DNA, 22 bp, Artificial Sequence
  chemically synthesized
ttatacatagtggaatttaatg

SEQ ID NO: 1403374 - DNA, 22 bp, Artificial Sequence
  chemically synthesized
taaacacagcacattaaattcc

SEQ ID NO: 1403375 - DNA, 22 bp, Artificial Sequence
  chemically synthesized
tttatacatagtggaatttaat

SEQ ID NO: 1403376 - DNA, 22 bp, Artificial Sequence
  chemically synthesized
aaacacagcacattaaattcca

SEQ ID NO: 1403377 - DNA, 22 bp, Artificial Sequence
  chemically synthesized
aacacagcacattaaattccac

SEQ ID NO: 1403378 - DNA, 22 bp, Artificial Sequence
  chemically synthesized
tatacagtcctttttatacata

SEQ ID NO: 1403379 - DNA, 22 bp, Artificial Sequence
  chemically synthesized
aattccactatgtataaaaagg

SEQ ID NO: 1403380 - DNA, 22 bp, Artificial Sequence
  chemically synthesized
acattatatacagtccttttta

SEQ ID NO: 1403381 - DNA, 22 bp, Artificial Sequence
  chemically synthesized
cactatgtataaaaaggactgt

SEQ ID NO: 1403382 - DNA, 22 bp, Artificial Sequence
  chemically synthesized
ttgacattatatacagtccttt

SEQ ID NO: 1403383 - DNA, 22 bp, Artificial Sequence
  chemically synthesized
tattgacattatatacagtcct

SEQ ID NO: 1403384 - DNA, 22 bp, Artificial Sequence
  chemically synthesized
tctattgacattatatacagtc

SEQ ID NO: 1403385 - DNA, 22 bp, Artificial Sequence
  chemically synthesized
tgtataaaaaggactgtatata

SEQ ID NO: 1403386 - DNA, 22 bp, Artificial Sequence
  chemically synthesized
ttctctattgacattatataca

SEQ ID NO: 1403387 - DNA, 22 bp, Artificial Sequence
  chemically synthesized
attctctattgacattatatac

SEQ ID NO: 1403388 - DNA, 22 bp, Artificial Sequence
  chemically synthesized
tttattctctattgacattata

SEQ ID NO: 1403389 - DNA, 22 bp, Artificial Sequence
  chemically synthesized
tgtttattctctattgacatta

SEQ ID NO: 1403390 - DNA, 22 bp, Artificial Sequence
  chemically synthesized
tatataatgtcaatagagaata

SEQ ID NO: 1403391 - DNA, 22 bp, Artificial Sequence
  chemically synthesized
tagcaattctgtttattctcta

SEQ ID NO: 1403392 - DNA, 22 bp, Artificial Sequence
  chemically synthesized
gtagcaattctgtttattctct

SEQ ID NO: 1403393 - DNA, 22 bp, Artificial Sequence
  chemically synthesized
tgtagcaattctgtttattctc

SEQ ID NO: 1403394 - DNA, 22 bp, Artificial Sequence
  chemically synthesized
ttgtagcaattctgtttattct

SEQ ID NO: 1403395 - DNA, 22 bp, Artificial Sequence
  chemically synthesized
tttgtagcaattctgtttattc

SEQ ID NO: 1403396 - DNA, 22 bp, Artificial Sequence
  chemically synthesized
tgtcgatgctttttgtagcaat

SEQ ID NO: 1403397 - DNA, 22 bp, Artificial Sequence
  chemically synthesized
atgtcgatgctttttgtagcaa

SEQ ID NO: 1403398 - DNA, 22 bp, Artificial Sequence
  chemically synthesized
atcatttatgtcgatgcttttt

SEQ ID NO: 1403399 - DNA, 22 bp, Artificial Sequence
  chemically synthesized
aatcatttatgtcgatgctttt

SEQ ID NO: 1403400 - DNA, 22 bp, Artificial Sequence
  chemically synthesized
ctacaaaaagcatcgacataaa

SEQ ID NO: 1403401 - DNA, 22 bp, Artificial Sequence
  chemically synthesized
tgtatatttaatcatttatgtc

SEQ ID NO: 1403402 - DNA, 22 bp, Artificial Sequence
  chemically synthesized
caaaaagcatcgacataaatga

SEQ ID NO: 1403403 - DNA, 22 bp, Artificial Sequence
  chemically synthesized
aatatacatagctcttggcatg

SEQ ID NO: 1403404 - DNA, 22 bp, Artificial Sequence
  chemically synthesized
tgtaacaggaagccacatgcca

SEQ ID NO: 1403405 - DNA, 22 bp, Artificial Sequence
  chemically synthesized
tgtgtaacaggaagccacatgc

SEQ ID NO: 1403406 - DNA, 22 bp, Artificial Sequence
  chemically synthesized
ttggcatgtggcttcctgttac

SEQ ID NO: 1403407 - DNA, 22 bp, Artificial Sequence
  chemically synthesized
ggcatgtggcttcctgttacac

SEQ ID NO: 1403408 - DNA, 22 bp, Artificial Sequence
  chemically synthesized
gcatgtggcttcctgttacaca

SEQ ID NO: 1403409 - DNA, 22 bp, Artificial Sequence
  chemically synthesized
aaaagcacaattctgtgtaaca

SEQ ID NO: 1403410 - DNA, 22 bp, Artificial Sequence
  chemically synthesized
ttaaaaagcacaattctgtgta

SEQ ID NO: 1403411 - DNA, 22 bp, Artificial Sequence
  chemically synthesized
cctgttacacagaattgtgctt

SEQ ID NO: 1403412 - DNA, 22 bp, Artificial Sequence
  chemically synthesized
tccattattaaaaagcacaatt

SEQ ID NO: 1403413 - DNA, 22 bp, Artificial Sequence
  chemically synthesized
ctgttacacagaattgtgcttt

SEQ ID NO: 1403414 - DNA, 22 bp, Artificial Sequence
  chemically synthesized
ttacacagaattgtgcttttta

SEQ ID NO: 1403415 - DNA, 22 bp, Artificial Sequence
  chemically synthesized
aaattatccattattaaaaagc

SEQ ID NO: 1403416 - DNA, 22 bp, Artificial Sequence
  chemically synthesized
cacagaattgtgctttttaata

SEQ ID NO: 1403417 - DNA, 22 bp, Artificial Sequence
  chemically synthesized
gaaattatccattattaaaaag

SEQ ID NO: 1403418 - DNA, 22 bp, Artificial Sequence
  chemically synthesized
tgaaattatccattattaaaaa

SEQ ID NO: 1403419 - DNA, 22 bp, Artificial Sequence
  chemically synthesized
gttttgaaattatccattatta

SEQ ID NO: 1403420 - DNA, 22 bp, Artificial Sequence
  chemically synthesized
tgctttttaataatggataatt

SEQ ID NO: 1403421 - DNA, 22 bp, Artificial Sequence
  chemically synthesized
tttaataatggataatttcaaa

SEQ ID NO: 1403422 - DNA, 22 bp, Artificial Sequence
  chemically synthesized
ttaataatggataatttcaaaa

SEQ ID NO: 1403423 - DNA, 22 bp, Artificial Sequence
  chemically synthesized
taataatggataatttcaaaac

SEQ ID NO: 1403424 - DNA, 22 bp, Artificial Sequence
  chemically synthesized
aataatggataatttcaaaacc

SEQ ID NO: 1403425 - DNA, 22 bp, Artificial Sequence
  chemically synthesized
ataatggataatttcaaaacca

SEQ ID NO: 1403426 - DNA, 22 bp, Artificial Sequence
  chemically synthesized
agtatccagcaaattggttttg

SEQ ID NO: 1403427 - DNA, 22 bp, Artificial Sequence
  chemically synthesized
caaaaccaatttgctggatact

SEQ ID NO: 1403428 - DNA, 22 bp, Artificial Sequence
  chemically synthesized
aaagatgcattaagtatccagc

SEQ ID NO: 1403429 - DNA, 22 bp, Artificial Sequence
  chemically synthesized
aaaaccaatttgctggatactt

SEQ ID NO: 1403430 - DNA, 22 bp, Artificial Sequence
  chemically synthesized
gctggatacttaatgcatcttt

SEQ ID NO: 1403431 - DNA, 22 bp, Artificial Sequence
  chemically synthesized
ctggatacttaatgcatctttg

SEQ ID NO: 1403432 - DNA, 22 bp, Artificial Sequence
  chemically synthesized
tggaaggaaaatctcaaagatg

SEQ ID NO: 1403433 - DNA, 22 bp, Artificial Sequence
  chemically synthesized
gatacttaatgcatctttgaga

SEQ ID NO: 1403434 - DNA, 22 bp, Artificial Sequence
  chemically synthesized
tgtggaaggaaaatctcaaaga

SEQ ID NO: 1403435 - DNA, 22 bp, Artificial Sequence
  chemically synthesized
tctgtggaaggaaaatctcaaa

SEQ ID NO: 1403436 - DNA, 22 bp, Artificial Sequence
  chemically synthesized
ctctgtggaaggaaaatctcaa

SEQ ID NO: 1403437 - DNA, 22 bp, Artificial Sequence
  chemically synthesized
aatgcatctttgagattttcct

SEQ ID NO: 1403438 - DNA, 22 bp, Artificial Sequence
  chemically synthesized
atgcatctttgagattttcctt

SEQ ID NO: 1403439 - DNA, 22 bp, Artificial Sequence
  chemically synthesized
aatcttctctgtggaaggaaaa

SEQ ID NO: 1403440 - DNA, 22 bp, Artificial Sequence
  chemically synthesized
ctaaatcttctctgtggaagga

SEQ ID NO: 1403441 - DNA, 22 bp, Artificial Sequence
  chemically synthesized
tgagattttccttccacagaga

SEQ ID NO: 1403442 - DNA, 22 bp, Artificial Sequence
  chemically synthesized
gagattttccttccacagagaa

SEQ ID NO: 1403443 - DNA, 22 bp, Artificial Sequence
  chemically synthesized
agattttccttccacagagaag

SEQ ID NO: 1403444 - DNA, 22 bp, Artificial Sequence
  chemically synthesized
taatctcctaaatcttctctgt

SEQ ID NO: 1403445 - DNA, 22 bp, Artificial Sequence
  chemically synthesized
ataatctcctaaatcttctctg

SEQ ID NO: 1403446 - DNA, 22 bp, Artificial Sequence
  chemically synthesized
tataatctcctaaatcttctct

SEQ ID NO: 1403447 - DNA, 22 bp, Artificial Sequence
  chemically synthesized
tccttccacagagaagatttag

SEQ ID NO: 1403448 - DNA, 22 bp, Artificial Sequence
  chemically synthesized
ctttataatctcctaaatcttc

SEQ ID NO: 1403449 - DNA, 22 bp, Artificial Sequence
  chemically synthesized
ccttccacagagaagatttagg

SEQ ID NO: 1403450 - DNA, 22 bp, Artificial Sequence
  chemically synthesized
cttccacagagaagatttagga

SEQ ID NO: 1403451 - DNA, 22 bp, Artificial Sequence
  chemically synthesized
attactttataatctcctaaat

SEQ ID NO: 1403452 - DNA, 22 bp, Artificial Sequence
  chemically synthesized
ccacagagaagatttaggagat

SEQ ID NO: 1403453 - DNA, 22 bp, Artificial Sequence
  chemically synthesized
cacagagaagatttaggagatt

SEQ ID NO: 1403454 - DNA, 22 bp, Artificial Sequence
  chemically synthesized
aggagattataaagtaattaat

SEQ ID NO: 1403455 - DNA, 22 bp, Artificial Sequence
  chemically synthesized
ggagattataaagtaattaatt

SEQ ID NO: 1403456 - DNA, 22 bp, Artificial Sequence
  chemically synthesized
ataaagaagtgaacaaattaat

SEQ ID NO: 1403457 - DNA, 22 bp, Artificial Sequence
  chemically synthesized
taaagtaattaatttgttcact

SEQ ID NO: 1403458 - DNA, 22 bp, Artificial Sequence
  chemically synthesized
gaaaattaataaagaagtgaac

SEQ ID NO: 1403459 - DNA, 22 bp, Artificial Sequence
  chemically synthesized
atttgttcacttctttattaat

SEQ ID NO: 1403460 - DNA, 22 bp, Artificial Sequence
  chemically synthesized
tgatattagaaaattaataaag

SEQ ID NO: 1403461 - DNA, 22 bp, Artificial Sequence
  chemically synthesized
gtgatattagaaaattaataaa

SEQ ID NO: 1403462 - DNA, 22 bp, Artificial Sequence
  chemically synthesized
tgtgatattagaaaattaataa

SEQ ID NO: 1403463 - DNA, 22 bp, Artificial Sequence
  chemically synthesized
gttcacttctttattaattttc

SEQ ID NO: 1403464 - DNA, 22 bp, Artificial Sequence
  chemically synthesized
ttcacttctttattaattttct

SEQ ID NO: 1403465 - DNA, 22 bp, Artificial Sequence
  chemically synthesized
acttctttattaattttctaat

SEQ ID NO: 1403466 - DNA, 22 bp, Artificial Sequence
  chemically synthesized
ctttattaattttctaatatca

SEQ ID NO: 1403467 - DNA, 22 bp, Artificial Sequence
  chemically synthesized
tttattaattttctaatatcac

SEQ ID NO: 1403468 - DNA, 22 bp, Artificial Sequence
  chemically synthesized
atgcatagctttgtgatattag

SEQ ID NO: 1403469 - DNA, 22 bp, Artificial Sequence
  chemically synthesized
tattaattttctaatatcacaa

SEQ ID NO: 1403470 - DNA, 22 bp, Artificial Sequence
  chemically synthesized
taatgcatagctttgtgatatt

SEQ ID NO: 1403471 - DNA, 22 bp, Artificial Sequence
  chemically synthesized
attaattttctaatatcacaaa

SEQ ID NO: 1403472 - DNA, 22 bp, Artificial Sequence
  chemically synthesized
ctaatgcatagctttgtgatat

SEQ ID NO: 1403473 - DNA, 22 bp, Artificial Sequence
  chemically synthesized
ttaattttctaatatcacaaag

SEQ ID NO: 1403474 - DNA, 22 bp, Artificial Sequence
  chemically synthesized
cttctaatgcatagctttgtga

SEQ ID NO: 1403475 - DNA, 22 bp, Artificial Sequence
  chemically synthesized
attttctaatatcacaaagcta

SEQ ID NO: 1403476 - DNA, 22 bp, Artificial Sequence
  chemically synthesized
ccttctaatgcatagctttgtg

SEQ ID NO: 1403477 - DNA, 22 bp, Artificial Sequence
  chemically synthesized
cttccttctaatgcatagcttt

SEQ ID NO: 1403478 - DNA, 22 bp, Artificial Sequence
  chemically synthesized
tctaatatcacaaagctatgca

SEQ ID NO: 1403479 - DNA, 22 bp, Artificial Sequence
  chemically synthesized
ctaatatcacaaagctatgcat

SEQ ID NO: 1403480 - DNA, 22 bp, Artificial Sequence
  chemically synthesized
taatatcacaaagctatgcatt

SEQ ID NO: 1403481 - DNA, 22 bp, Artificial Sequence
  chemically synthesized
atatcacaaagctatgcattag

SEQ ID NO: 1403482 - DNA, 22 bp, Artificial Sequence
  chemically synthesized
atacctacttccttctaatgca

SEQ ID NO: 1403483 - DNA, 22 bp, Artificial Sequence
  chemically synthesized
tgcattagaaggaagtaggtat

SEQ ID NO: 1403484 - DNA, 22 bp, Artificial Sequence
  chemically synthesized
gaaggaagtaggtattaacatc

SEQ ID NO: 1403485 - DNA, 22 bp, Artificial Sequence
  chemically synthesized
agtggatgtatcaaatgatatg

SEQ ID NO: 1403486 - DNA, 22 bp, Artificial Sequence
  chemically synthesized
acatctcatatcatttgataca

SEQ ID NO: 1403487 - DNA, 22 bp, Artificial Sequence
  chemically synthesized
atatcatttgatacatccactg

SEQ ID NO: 1403488 - DNA, 22 bp, Artificial Sequence
  chemically synthesized
caaagagcgtaggaattcagtg

SEQ ID NO: 1403489 - DNA, 22 bp, Artificial Sequence
  chemically synthesized
gatacatccactgaattcctac

SEQ ID NO: 1403490 - DNA, 22 bp, Artificial Sequence
  chemically synthesized
atacatccactgaattcctacg

SEQ ID NO: 1403491 - DNA, 22 bp, Artificial Sequence
  chemically synthesized
aggctgcaaagagcgtaggaat

SEQ ID NO: 1403492 - DNA, 22 bp, Artificial Sequence
  chemically synthesized
gaggctgcaaagagcgtaggaa

SEQ ID NO: 1403493 - DNA, 22 bp, Artificial Sequence
  chemically synthesized
aattcctacgctctttgcagcc

SEQ ID NO: 1403494 - DNA, 22 bp, Artificial Sequence
  chemically synthesized
ctacgctctttgcagcctcaag

SEQ ID NO: 1403495 - DNA, 22 bp, Artificial Sequence
  chemically synthesized
cgctctttgcagcctcaaggca

SEQ ID NO: 1403496 - DNA, 22 bp, Artificial Sequence
  chemically synthesized
ccagcacacaggtgccttgagg

SEQ ID NO: 1403497 - DNA, 22 bp, Artificial Sequence
  chemically synthesized
tttgcagcctcaaggcacctgt

SEQ ID NO: 1403498 - DNA, 22 bp, Artificial Sequence
  chemically synthesized
tgcagcctcaaggcacctgtgt

SEQ ID NO: 1403499 - DNA, 22 bp, Artificial Sequence
  chemically synthesized
gcagcctcaaggcacctgtgtg

SEQ ID NO: 1403500 - DNA, 22 bp, Artificial Sequence
  chemically synthesized
cagcctcaaggcacctgtgtgc

SEQ ID NO: 1403501 - DNA, 22 bp, Artificial Sequence
  chemically synthesized
caaagtctgccagcacacaggt

SEQ ID NO: 1403502 - DNA, 22 bp, Artificial Sequence
  chemically synthesized
tgcaaagtctgccagcacacag

SEQ ID NO: 1403503 - DNA, 22 bp, Artificial Sequence
  chemically synthesized
aaggcacctgtgtgctggcaga

SEQ ID NO: 1403504 - DNA, 22 bp, Artificial Sequence
  chemically synthesized
agtagtactctgcaaagtctgc

SEQ ID NO: 1403505 - DNA, 22 bp, Artificial Sequence
  chemically synthesized
cagtagtactctgcaaagtctg

SEQ ID NO: 1403506 - DNA, 22 bp, Artificial Sequence
  chemically synthesized
tgtgctggcagactttgcagag

SEQ ID NO: 1403507 - DNA, 22 bp, Artificial Sequence
  chemically synthesized
aacttcagtagtactctgcaaa

SEQ ID NO: 1403508 - DNA, 22 bp, Artificial Sequence
  chemically synthesized
gcagactttgcagagtactact

SEQ ID NO: 1403509 - DNA, 22 bp, Artificial Sequence
  chemically synthesized
cagcctcaacttcagtagtact

SEQ ID NO: 1403510 - DNA, 22 bp, Artificial Sequence
  chemically synthesized
acagcctcaacttcagtagtac

SEQ ID NO: 1403511 - DNA, 22 bp, Artificial Sequence
  chemically synthesized
gtttacagcctcaacttcagta

SEQ ID NO: 1403512 - DNA, 22 bp, Artificial Sequence
  chemically synthesized
tgcagagtactactgaagttga

SEQ ID NO: 1403513 - DNA, 22 bp, Artificial Sequence
  chemically synthesized
gcagagtactactgaagttgag

SEQ ID NO: 1403514 - DNA, 22 bp, Artificial Sequence
  chemically synthesized
cagagtactactgaagttgagg

SEQ ID NO: 1403515 - DNA, 22 bp, Artificial Sequence
  chemically synthesized
ctgaagttgaggctgtaaacca

SEQ ID NO: 1403516 - DNA, 22 bp, Artificial Sequence
  chemically synthesized
aagttgaggctgtaaaccaatc

SEQ ID NO: 1403517 - DNA, 22 bp, Artificial Sequence
  chemically synthesized
aggctgtaaaccaatcacgcat

SEQ ID NO: 1403518 - DNA, 22 bp, Artificial Sequence
  chemically synthesized
taaaccaatcacgcatttgctc

SEQ ID NO: 1403519 - DNA, 22 bp, Artificial Sequence
  chemically synthesized
gctctgctttcatattgctggc

SEQ ID NO: 1403520 - DNA, 22 bp, Artificial Sequence
  chemically synthesized
ctctgctttcatattgctggca

SEQ ID NO: 1403521 - DNA, 22 bp, Artificial Sequence
  chemically synthesized
tgctttcatattgctggcatta

SEQ ID NO: 1403522 - DNA, 22 bp, Artificial Sequence
  chemically synthesized
ctttcatattgctggcattata

SEQ ID NO: 1403523 - DNA, 22 bp, Artificial Sequence
  chemically synthesized
gcgaatagcagatgtataatgc

SEQ ID NO: 1403524 - DNA, 22 bp, Artificial Sequence
  chemically synthesized
tcatattgctggcattatacat

SEQ ID NO: 1403525 - DNA, 22 bp, Artificial Sequence
  chemically synthesized
catattgctggcattatacatc

SEQ ID NO: 1403526 - DNA, 22 bp, Artificial Sequence
  chemically synthesized
atattgctggcattatacatct

SEQ ID NO: 1403527 - DNA, 22 bp, Artificial Sequence
  chemically synthesized
gggttggcgaatagcagatgta

SEQ ID NO: 1403528 - DNA, 22 bp, Artificial Sequence
  chemically synthesized
ggggttggcgaatagcagatgt

SEQ ID NO: 1403529 - DNA, 22 bp, Artificial Sequence
  chemically synthesized
ctggcattatacatctgctatt

SEQ ID NO: 1403530 - DNA, 22 bp, Artificial Sequence
  chemically synthesized
gcattatacatctgctattcgc

SEQ ID NO: 1403531 - DNA, 22 bp, Artificial Sequence
  chemically synthesized
aaggatttggggttggcgaata

SEQ ID NO: 1403532 - DNA, 22 bp, Artificial Sequence
  chemically synthesized
tacatctgctattcgccaaccc

SEQ ID NO: 1403533 - DNA, 22 bp, Artificial Sequence
  chemically synthesized
catactgaaggatttggggttg

SEQ ID NO: 1403534 - DNA, 22 bp, Artificial Sequence
  chemically synthesized
ctattcgccaaccccaaatcct

SEQ ID NO: 1403535 - DNA, 22 bp, Artificial Sequence
  chemically synthesized
ttcgccaaccccaaatccttca

SEQ ID NO: 1403536 - DNA, 22 bp, Artificial Sequence
  chemically synthesized
gccaaccccaaatccttcagta

SEQ ID NO: 1403537 - DNA, 22 bp, Artificial Sequence
  chemically synthesized
atcagaaaatgagaactacata

SEQ ID NO: 1403538 - DNA, 22 bp, Artificial Sequence
  chemically synthesized
catcagaaaatgagaactacat

SEQ ID NO: 1403539 - DNA, 22 bp, Artificial Sequence
  chemically synthesized
tcatcagaaaatgagaactaca

SEQ ID NO: 1403540 - DNA, 22 bp, Artificial Sequence
  chemically synthesized
aattttcatcagaaaatgagaa

SEQ ID NO: 1403541 - DNA, 22 bp, Artificial Sequence
  chemically synthesized
cagtatgtagttctcattttct

SEQ ID NO: 1403542 - DNA, 22 bp, Artificial Sequence
  chemically synthesized
agtatgtagttctcattttctg

SEQ ID NO: 1403543 - DNA, 22 bp, Artificial Sequence
  chemically synthesized
cactgaattttcatcagaaaat

SEQ ID NO: 1403544 - DNA, 22 bp, Artificial Sequence
  chemically synthesized
ccactgaattttcatcagaaaa

SEQ ID NO: 1403545 - DNA, 22 bp, Artificial Sequence
  chemically synthesized
tccactgaattttcatcagaaa

SEQ ID NO: 1403546 - DNA, 22 bp, Artificial Sequence
  chemically synthesized
ttccactgaattttcatcagaa

SEQ ID NO: 1403547 - DNA, 22 bp, Artificial Sequence
  chemically synthesized
tttccactgaattttcatcaga

SEQ ID NO: 1403548 - DNA, 22 bp, Artificial Sequence
  chemically synthesized
cattttttccactgaattttca

SEQ ID NO: 1403549 - DNA, 22 bp, Artificial Sequence
  chemically synthesized
tcattttctgatgaaaattcag

SEQ ID NO: 1403550 - DNA, 22 bp, Artificial Sequence
  chemically synthesized
ccattttttccactgaattttc

SEQ ID NO: 1403551 - DNA, 22 bp, Artificial Sequence
  chemically synthesized
attttctgatgaaaattcagtg

SEQ ID NO: 1403552 - DNA, 22 bp, Artificial Sequence
  chemically synthesized
cttccattttttccactgaatt

SEQ ID NO: 1403553 - DNA, 22 bp, Artificial Sequence
  chemically synthesized
tctgatgaaaattcagtggaaa

SEQ ID NO: 1403554 - DNA, 22 bp, Artificial Sequence
  chemically synthesized
ctgatgaaaattcagtggaaaa

SEQ ID NO: 1403555 - DNA, 22 bp, Artificial Sequence
  chemically synthesized
tgatgaaaattcagtggaaaaa

SEQ ID NO: 1403556 - DNA, 22 bp, Artificial Sequence
  chemically synthesized
atgaaaattcagtggaaaaaat

SEQ ID NO: 1403557 - DNA, 22 bp, Artificial Sequence
  chemically synthesized
aaagcaaatatctacttccatt

SEQ ID NO: 1403558 - DNA, 22 bp, Artificial Sequence
  chemically synthesized
agtggaaaaaatggaagtagat

SEQ ID NO: 1403559 - DNA, 22 bp, Artificial Sequence
  chemically synthesized
aaattaaaagcaaatatctact

SEQ ID NO: 1403560 - DNA, 22 bp, Artificial Sequence
  chemically synthesized
taaagtatacctgaaattaaaa

SEQ ID NO: 1403561 - DNA, 22 bp, Artificial Sequence
  chemically synthesized
ttgtaaagtatacctgaaatta

SEQ ID NO: 1403562 - DNA, 22 bp, Artificial Sequence
  chemically synthesized
gcttttaatttcaggtatactt

SEQ ID NO: 1403563 - DNA, 22 bp, Artificial Sequence
  chemically synthesized
cttttaatttcaggtatacttt

SEQ ID NO: 1403564 - DNA, 22 bp, Artificial Sequence
  chemically synthesized
ttaatttcaggtatactttaca

SEQ ID NO: 1403565 - DNA, 22 bp, Artificial Sequence
  chemically synthesized
taatttcaggtatactttacaa

SEQ ID NO: 1403566 - DNA, 22 bp, Artificial Sequence
  chemically synthesized
aatttcaggtatactttacaat

SEQ ID NO: 1403567 - DNA, 22 bp, Artificial Sequence
  chemically synthesized
tgcagcatggttattgtaaagt

SEQ ID NO: 1403568 - DNA, 22 bp, Artificial Sequence
  chemically synthesized
atttcaggtatactttacaata

SEQ ID NO: 1403569 - DNA, 22 bp, Artificial Sequence
  chemically synthesized
caggtatactttacaataacca

SEQ ID NO: 1403570 - DNA, 22 bp, Artificial Sequence
  chemically synthesized
tactgtgcagcatggttattgt

SEQ ID NO: 1403571 - DNA, 22 bp, Artificial Sequence
  chemically synthesized
aggtatactttacaataaccat

SEQ ID NO: 1403572 - DNA, 22 bp, Artificial Sequence
  chemically synthesized
tacaataaccatgctgcacagt

SEQ ID NO: 1403573 - DNA, 22 bp, Artificial Sequence
  chemically synthesized
acaataaccatgctgcacagta

SEQ ID NO: 1403574 - DNA, 22 bp, Artificial Sequence
  chemically synthesized
caataaccatgctgcacagtac

SEQ ID NO: 1403575 - DNA, 22 bp, Artificial Sequence
  chemically synthesized
accaatcacccaattgtactgt

SEQ ID NO: 1403576 - DNA, 22 bp, Artificial Sequence
  chemically synthesized
cacagtacaattgggtgattgg

SEQ ID NO: 1403577 - DNA, 22 bp, Artificial Sequence
  chemically synthesized
atagaaaatgatggagttcacc

SEQ ID NO: 1403578 - DNA, 22 bp, Artificial Sequence
  chemically synthesized
ggtgattggtgaactccatcat

SEQ ID NO: 1403579 - DNA, 22 bp, Artificial Sequence
  chemically synthesized
atcactaatagaaaatgatgga

SEQ ID NO: 1403580 - DNA, 22 bp, Artificial Sequence
  chemically synthesized
catcactaatagaaaatgatgg

SEQ ID NO: 1403581 - DNA, 22 bp, Artificial Sequence
  chemically synthesized
tttcatcactaatagaaaatga

SEQ ID NO: 1403582 - DNA, 22 bp, Artificial Sequence
  chemically synthesized
gtttcatcactaatagaaaatg

SEQ ID NO: 1403583 - DNA, 22 bp, Artificial Sequence
  chemically synthesized
gtgaactccatcattttctatt

SEQ ID NO: 1403584 - DNA, 22 bp, Artificial Sequence
  chemically synthesized
tcttgtttcatcactaatagaa

SEQ ID NO: 1403585 - DNA, 22 bp, Artificial Sequence
  chemically synthesized
gtcttgtttcatcactaataga

SEQ ID NO: 1403586 - DNA, 22 bp, Artificial Sequence
  chemically synthesized
catcattttctattagtgatga

SEQ ID NO: 1403587 - DNA, 22 bp, Artificial Sequence
  chemically synthesized
atttgtcttgtttcatcactaa

SEQ ID NO: 1403588 - DNA, 22 bp, Artificial Sequence
  chemically synthesized
catttgtcttgtttcatcacta

SEQ ID NO: 1403589 - DNA, 22 bp, Artificial Sequence
  chemically synthesized
ttcatttgtcttgtttcatcac

SEQ ID NO: 1403590 - DNA, 22 bp, Artificial Sequence
  chemically synthesized
tctattagtgatgaaacaagac

SEQ ID NO: 1403591 - DNA, 22 bp, Artificial Sequence
  chemically synthesized
ctattagtgatgaaacaagaca

SEQ ID NO: 1403592 - DNA, 22 bp, Artificial Sequence
  chemically synthesized
tattagtgatgaaacaagacaa

SEQ ID NO: 1403593 - DNA, 22 bp, Artificial Sequence
  chemically synthesized
ttagtgatgaaacaagacaaat

SEQ ID NO: 1403594 - DNA, 22 bp, Artificial Sequence
  chemically synthesized
gtgatgaaacaagacaaatgaa

SEQ ID NO: 1403595 - DNA, 22 bp, Artificial Sequence
  chemically synthesized
gtaaagtaacacaaagcaaaaa

SEQ ID NO: 1403596 - DNA, 22 bp, Artificial Sequence
  chemically synthesized
aggcatattggtaaagtaacac

SEQ ID NO: 1403597 - DNA, 22 bp, Artificial Sequence
  chemically synthesized
ttgctttgtgttactttaccaa

SEQ ID NO: 1403598 - DNA, 22 bp, Artificial Sequence
  chemically synthesized
tgctttgtgttactttaccaat

SEQ ID NO: 1403599 - DNA, 22 bp, Artificial Sequence
  chemically synthesized
gctttgtgttactttaccaata

SEQ ID NO: 1403600 - DNA, 22 bp, Artificial Sequence
  chemically synthesized
ctttgtgttactttaccaatat

SEQ ID NO: 1403601 - DNA, 22 bp, Artificial Sequence
  chemically synthesized
tgtgttactttaccaatatgcc

SEQ ID NO: 1403602 - DNA, 22 bp, Artificial Sequence
  chemically synthesized
gtgttactttaccaatatgcct

SEQ ID NO: 1403603 - DNA, 22 bp, Artificial Sequence
  chemically synthesized
tgttactttaccaatatgcctg

SEQ ID NO: 1403604 - DNA, 22 bp, Artificial Sequence
  chemically synthesized
taaggtacatggattcaggcat

SEQ ID NO: 1403605 - DNA, 22 bp, Artificial Sequence
  chemically synthesized
ataaggtacatggattcaggca

SEQ ID NO: 1403606 - DNA, 22 bp, Artificial Sequence
  chemically synthesized
ctttaccaatatgcctgaatcc

SEQ ID NO: 1403607 - DNA, 22 bp, Artificial Sequence
  chemically synthesized
taccaatatgcctgaatccatg

SEQ ID NO: 1403608 - DNA, 22 bp, Artificial Sequence
  chemically synthesized
gtttataaggtacatggattca

SEQ ID NO: 1403609 - DNA, 22 bp, Artificial Sequence
  chemically synthesized
accaatatgcctgaatccatgt

SEQ ID NO: 1403610 - DNA, 22 bp, Artificial Sequence
  chemically synthesized
cgtttataaggtacatggattc

SEQ ID NO: 1403611 - DNA, 22 bp, Artificial Sequence
  chemically synthesized
ccaatatgcctgaatccatgta

SEQ ID NO: 1403612 - DNA, 22 bp, Artificial Sequence
  chemically synthesized
acagtttcgtttataaggtaca

SEQ ID NO: 1403613 - DNA, 22 bp, Artificial Sequence
  chemically synthesized
aatccatgtaccttataaacga

SEQ ID NO: 1403614 - DNA, 22 bp, Artificial Sequence
  chemically synthesized
ataaacgaaactgtcaatttac

SEQ ID NO: 1403615 - DNA, 22 bp, Artificial Sequence
  chemically synthesized
taaacgaaactgtcaatttact

SEQ ID NO: 1403616 - DNA, 22 bp, Artificial Sequence
  chemically synthesized
aaataatagaagagtaaattga

SEQ ID NO: 1403617 - DNA, 22 bp, Artificial Sequence
  chemically synthesized
tcaatttactcttctattattt

SEQ ID NO: 1403618 - DNA, 22 bp, Artificial Sequence
  chemically synthesized
atggaatcatcacctaaaataa

SEQ ID NO: 1403619 - DNA, 22 bp, Artificial Sequence
  chemically synthesized
aatggaatcatcacctaaaata

SEQ ID NO: 1403620 - DNA, 22 bp, Artificial Sequence
  chemically synthesized
actcttctattattttaggtga

SEQ ID NO: 1403621 - DNA, 22 bp, Artificial Sequence
  chemically synthesized
ctcttctattattttaggtgat

SEQ ID NO: 1403622 - DNA, 22 bp, Artificial Sequence
  chemically synthesized
atttaatggaatcatcacctaa

SEQ ID NO: 1403623 - DNA, 22 bp, Artificial Sequence
  chemically synthesized
aatttaatggaatcatcaccta

SEQ ID NO: 1403624 - DNA, 22 bp, Artificial Sequence
  chemically synthesized
ttctattattttaggtgatgat

SEQ ID NO: 1403625 - DNA, 22 bp, Artificial Sequence
  chemically synthesized
ctattattttaggtgatgattc

SEQ ID NO: 1403626 - DNA, 22 bp, Artificial Sequence
  chemically synthesized
tattattttaggtgatgattcc

SEQ ID NO: 1403627 - DNA, 22 bp, Artificial Sequence
  chemically synthesized
ttattttaggtgatgattccat

SEQ ID NO: 1403628 - DNA, 22 bp, Artificial Sequence
  chemically synthesized
ttttaggtgatgattccattaa

SEQ ID NO: 1403629 - DNA, 22 bp, Artificial Sequence
  chemically synthesized
taggtgatgattccattaaatt

SEQ ID NO: 1403630 - DNA, 22 bp, Artificial Sequence
  chemically synthesized
cccagaggtcttaatttaatgg

SEQ ID NO: 1403631 - DNA, 22 bp, Artificial Sequence
  chemically synthesized
aggtgatgattccattaaatta

SEQ ID NO: 1403632 - DNA, 22 bp, Artificial Sequence
  chemically synthesized
ggtgatgattccattaaattaa

SEQ ID NO: 1403633 - DNA, 22 bp, Artificial Sequence
  chemically synthesized
cacatgacctccccagaggtct

SEQ ID NO: 1403634 - DNA, 22 bp, Artificial Sequence
  chemically synthesized
acacatgacctccccagaggtc

SEQ ID NO: 1403635 - DNA, 22 bp, Artificial Sequence
  chemically synthesized
cattaaattaagacctctgggg

SEQ ID NO: 1403636 - DNA, 22 bp, Artificial Sequence
  chemically synthesized
aattaagacctctggggaggtc

SEQ ID NO: 1403637 - DNA, 22 bp, Artificial Sequence
  chemically synthesized
tgacttacacatgacctcccca

SEQ ID NO: 1403638 - DNA, 22 bp, Artificial Sequence
  chemically synthesized
gtgacttacacatgacctcccc

SEQ ID NO: 1403639 - DNA, 22 bp, Artificial Sequence
  chemically synthesized
tgtgacttacacatgacctccc

SEQ ID NO: 1403640 - DNA, 22 bp, Artificial Sequence
  chemically synthesized
agacctctggggaggtcatgtg

SEQ ID NO: 1403641 - DNA, 22 bp, Artificial Sequence
  chemically synthesized
ctttgtgacttacacatgacct

SEQ ID NO: 1403642 - DNA, 22 bp, Artificial Sequence
  chemically synthesized
cctttgtgacttacacatgacc

SEQ ID NO: 1403643 - DNA, 22 bp, Artificial Sequence
  chemically synthesized
tttcctttgtgacttacacatg

SEQ ID NO: 1403644 - DNA, 22 bp, Artificial Sequence
  chemically synthesized
tatttcctttgtgacttacaca

SEQ ID NO: 1403645 - DNA, 22 bp, Artificial Sequence
  chemically synthesized
tggggaggtcatgtgtaagtca

SEQ ID NO: 1403646 - DNA, 22 bp, Artificial Sequence
  chemically synthesized
gggaggtcatgtgtaagtcaca

SEQ ID NO: 1403647 - DNA, 22 bp, Artificial Sequence
  chemically synthesized
aaggctctatttcctttgtgac

SEQ ID NO: 1403648 - DNA, 22 bp, Artificial Sequence
  chemically synthesized
aaaggctctatttcctttgtga

SEQ ID NO: 1403649 - DNA, 22 bp, Artificial Sequence
  chemically synthesized
taaaggctctatttcctttgtg

SEQ ID NO: 1403650 - DNA, 22 bp, Artificial Sequence
  chemically synthesized
catggtattttaaaggctctat

SEQ ID NO: 1403651 - DNA, 22 bp, Artificial Sequence
  chemically synthesized
ccctacatggtattttaaaggc

SEQ ID NO: 1403652 - DNA, 22 bp, Artificial Sequence
  chemically synthesized
taaaataccatgtagggtaact

SEQ ID NO: 1403653 - DNA, 22 bp, Artificial Sequence
  chemically synthesized
tgatggtatgatagttacccta

SEQ ID NO: 1403654 - DNA, 22 bp, Artificial Sequence
  chemically synthesized
aaaataccatgtagggtaacta

SEQ ID NO: 1403655 - DNA, 22 bp, Artificial Sequence
  chemically synthesized
aaataccatgtagggtaactat

SEQ ID NO: 1403656 - DNA, 22 bp, Artificial Sequence
  chemically synthesized
gttatgatggtatgatagttac

SEQ ID NO: 1403657 - DNA, 22 bp, Artificial Sequence
  chemically synthesized
agttatgatggtatgatagtta

SEQ ID NO: 1403658 - DNA, 22 bp, Artificial Sequence
  chemically synthesized
tcataccatcataactaaatat

SEQ ID NO: 1403659 - DNA, 22 bp, Artificial Sequence
  chemically synthesized
acaccgtaaaagtcgggatatt

SEQ ID NO: 1403660 - DNA, 22 bp, Artificial Sequence
  chemically synthesized
cacaccgtaaaagtcgggatat

SEQ ID NO: 1403661 - DNA, 22 bp, Artificial Sequence
  chemically synthesized
tttcacaccgtaaaagtcggga

SEQ ID NO: 1403662 - DNA, 22 bp, Artificial Sequence
  chemically synthesized
tctatttcacaccgtaaaagtc

SEQ ID NO: 1403663 - DNA, 22 bp, Artificial Sequence
  chemically synthesized
gtctatttcacaccgtaaaagt

SEQ ID NO: 1403664 - DNA, 22 bp, Artificial Sequence
  chemically synthesized
tgtctatttcacaccgtaaaag

SEQ ID NO: 1403665 - DNA, 22 bp, Artificial Sequence
  chemically synthesized
ttgtctatttcacaccgtaaaa

SEQ ID NO: 1403666 - DNA, 22 bp, Artificial Sequence
  chemically synthesized
aatatcccgacttttacggtgt

SEQ ID NO: 1403667 - DNA, 22 bp, Artificial Sequence
  chemically synthesized
ccatttttgtctatttcacacc

SEQ ID NO: 1403668 - DNA, 22 bp, Artificial Sequence
  chemically synthesized
ttacggtgtgaaatagacaaaa

SEQ ID NO: 1403669 - DNA, 22 bp, Artificial Sequence
  chemically synthesized
tacggtgtgaaatagacaaaaa

SEQ ID NO: 1403670 - DNA, 22 bp, Artificial Sequence
  chemically synthesized
acggtgtgaaatagacaaaaat

SEQ ID NO: 1403671 - DNA, 22 bp, Artificial Sequence
  chemically synthesized
acccaagttaccatttttgtct

SEQ ID NO: 1403672 - DNA, 22 bp, Artificial Sequence
  chemically synthesized
cggtgtgaaatagacaaaaatg

SEQ ID NO: 1403673 - DNA, 22 bp, Artificial Sequence
  chemically synthesized
gggaaatgcgttgacccaagtt

SEQ ID NO: 1403674 - DNA, 22 bp, Artificial Sequence
  chemically synthesized
agggaaatgcgttgacccaagt

SEQ ID NO: 1403675 - DNA, 22 bp, Artificial Sequence
  chemically synthesized
agtttagggaaatgcgttgacc

SEQ ID NO: 1403676 - DNA, 22 bp, Artificial Sequence
  chemically synthesized
attcagtttagggaaatgcgtt

SEQ ID NO: 1403677 - DNA, 22 bp, Artificial Sequence
  chemically synthesized
ctcattcagtttagggaaatgc

SEQ ID NO: 1403678 - DNA, 22 bp, Artificial Sequence
  chemically synthesized
ctcctcattcagtttagggaaa

SEQ ID NO: 1403679 - DNA, 22 bp, Artificial Sequence
  chemically synthesized
gggtcaacgcatttccctaaac

SEQ ID NO: 1403680 - DNA, 22 bp, Artificial Sequence
  chemically synthesized
ggtcaacgcatttccctaaact

SEQ ID NO: 1403681 - DNA, 22 bp, Artificial Sequence
  chemically synthesized
tcaagattcctcctcattcagt

SEQ ID NO: 1403682 - DNA, 22 bp, Artificial Sequence
  chemically synthesized
ttgtcaagattcctcctcattc

SEQ ID NO: 1403683 - DNA, 22 bp, Artificial Sequence
  chemically synthesized
ccctaaactgaatgaggaggaa

SEQ ID NO: 1403684 - DNA, 22 bp, Artificial Sequence
  chemically synthesized
cctaaactgaatgaggaggaat

SEQ ID NO: 1403685 - DNA, 22 bp, Artificial Sequence
  chemically synthesized
aactgaatgaggaggaatcttg

SEQ ID NO: 1403686 - DNA, 22 bp, Artificial Sequence
  chemically synthesized
aatgaggaggaatcttgacaat

SEQ ID NO: 1403687 - DNA, 22 bp, Artificial Sequence
  chemically synthesized
accatagtacacgagcagtact

SEQ ID NO: 1403688 - DNA, 22 bp, Artificial Sequence
  chemically synthesized
ctaaccatagtacacgagcagt

SEQ ID NO: 1403689 - DNA, 22 bp, Artificial Sequence
  chemically synthesized
gacaatagtactgctcgtgtac

SEQ ID NO: 1403690 - DNA, 22 bp, Artificial Sequence
  chemically synthesized
acaatagtactgctcgtgtact

SEQ ID NO: 1403691 - DNA, 22 bp, Artificial Sequence
  chemically synthesized
atattactaaccatagtacacg

SEQ ID NO: 1403692 - DNA, 22 bp, Artificial Sequence
  chemically synthesized
taatattactaaccatagtaca

SEQ ID NO: 1403693 - DNA, 22 bp, Artificial Sequence
  chemically synthesized
cctctaatattactaaccatag

SEQ ID NO: 1403694 - DNA, 22 bp, Artificial Sequence
  chemically synthesized
ccctctaatattactaaccata

SEQ ID NO: 1403695 - DNA, 22 bp, Artificial Sequence
  chemically synthesized
ttccctctaatattactaacca

SEQ ID NO: 1403696 - DNA, 22 bp, Artificial Sequence
  chemically synthesized
ctcgtgtactatggttagtaat

SEQ ID NO: 1403697 - DNA, 22 bp, Artificial Sequence
  chemically synthesized
cttccctctaatattactaacc

SEQ ID NO: 1403698 - DNA, 22 bp, Artificial Sequence
  chemically synthesized
gtgtactatggttagtaatatt

SEQ ID NO: 1403699 - DNA, 22 bp, Artificial Sequence
  chemically synthesized
catccttcttccctctaatatt

SEQ ID NO: 1403700 - DNA, 22 bp, Artificial Sequence
  chemically synthesized
tggttagtaatattagagggaa

SEQ ID NO: 1403701 - DNA, 22 bp, Artificial Sequence
  chemically synthesized
cattgcatccttcttccctcta

SEQ ID NO: 1403702 - DNA, 22 bp, Artificial Sequence
  chemically synthesized
ccattgcatccttcttccctct

SEQ ID NO: 1403703 - DNA, 22 bp, Artificial Sequence
  chemically synthesized
gtaatattagagggaagaagga

SEQ ID NO: 1403704 - DNA, 22 bp, Artificial Sequence
  chemically synthesized
gagggaagaaggatgcaatgga

SEQ ID NO: 1403705 - DNA, 22 bp, Artificial Sequence
  chemically synthesized
aggtgacatcatttccattgca

SEQ ID NO: 1403706 - DNA, 22 bp, Artificial Sequence
  chemically synthesized
agtcctaaggtgacatcatttc

SEQ ID NO: 1403707 - DNA, 22 bp, Artificial Sequence
  chemically synthesized
gagtcctaaggtgacatcattt

SEQ ID NO: 1403708 - DNA, 22 bp, Artificial Sequence
  chemically synthesized
tttgagtcctaaggtgacatca

SEQ ID NO: 1403709 - DNA, 22 bp, Artificial Sequence
  chemically synthesized
gtttgagtcctaaggtgacatc

SEQ ID NO: 1403710 - DNA, 22 bp, Artificial Sequence
  chemically synthesized
cacagccagtaagacatttgtt

SEQ ID NO: 1403711 - DNA, 22 bp, Artificial Sequence
  chemically synthesized
aggactcaaacaaatgtcttac

SEQ ID NO: 1403712 - DNA, 22 bp, Artificial Sequence
  chemically synthesized
ggactcaaacaaatgtcttact

SEQ ID NO: 1403713 - DNA, 22 bp, Artificial Sequence
  chemically synthesized
aaacaaatgtcttactggctgt

SEQ ID NO: 1403714 - DNA, 22 bp, Artificial Sequence
  chemically synthesized
aagtagtaatgagttacacagc

SEQ ID NO: 1403715 - DNA, 22 bp, Artificial Sequence
  chemically synthesized
aaagtagtaatgagttacacag

SEQ ID NO: 1403716 - DNA, 22 bp, Artificial Sequence
  chemically synthesized
acttaaagtagtaatgagttac

SEQ ID NO: 1403717 - DNA, 22 bp, Artificial Sequence
  chemically synthesized
aacttaaagtagtaatgagtta

SEQ ID NO: 1403718 - DNA, 22 bp, Artificial Sequence
  chemically synthesized
actggctgtgtaactcattact

SEQ ID NO: 1403719 - DNA, 22 bp, Artificial Sequence
  chemically synthesized
ctggctgtgtaactcattacta

SEQ ID NO: 1403720 - DNA, 22 bp, Artificial Sequence
  chemically synthesized
gctgtgtaactcattactactt

SEQ ID NO: 1403721 - DNA, 22 bp, Artificial Sequence
  chemically synthesized
aagtttaacttaaagtagtaat

SEQ ID NO: 1403722 - DNA, 22 bp, Artificial Sequence
  chemically synthesized
ctcaagtttaacttaaagtagt

SEQ ID NO: 1403723 - DNA, 22 bp, Artificial Sequence
  chemically synthesized
tgtaactcattactactttaag

SEQ ID NO: 1403724 - DNA, 22 bp, Artificial Sequence
  chemically synthesized
attactactttaagttaaactt

SEQ ID NO: 1403725 - DNA, 22 bp, Artificial Sequence
  chemically synthesized
gagggagctactcaagtttaac

SEQ ID NO: 1403726 - DNA, 22 bp, Artificial Sequence
  chemically synthesized
tggagggagctactcaagttta

SEQ ID NO: 1403727 - DNA, 22 bp, Artificial Sequence
  chemically synthesized
ctactttaagttaaacttgagt

SEQ ID NO: 1403728 - DNA, 22 bp, Artificial Sequence
  chemically synthesized
ctggagggagctactcaagttt

SEQ ID NO: 1403729 - DNA, 22 bp, Artificial Sequence
  chemically synthesized
ttctggagggagctactcaagt

SEQ ID NO: 1403730 - DNA, 22 bp, Artificial Sequence
  chemically synthesized
ctttaagttaaacttgagtagc

SEQ ID NO: 1403731 - DNA, 22 bp, Artificial Sequence
  chemically synthesized
taagttaaacttgagtagctcc

SEQ ID NO: 1403732 - DNA, 22 bp, Artificial Sequence
  chemically synthesized
gctcttctggagggagctactc

SEQ ID NO: 1403733 - DNA, 22 bp, Artificial Sequence
  chemically synthesized
aagttaaacttgagtagctccc

SEQ ID NO: 1403734 - DNA, 22 bp, Artificial Sequence
  chemically synthesized
agctcttctggagggagctact

SEQ ID NO: 1403735 - DNA, 22 bp, Artificial Sequence
  chemically synthesized
agttaaacttgagtagctccct

SEQ ID NO: 1403736 - DNA, 22 bp, Artificial Sequence
  chemically synthesized
cttagctcttctggagggagct

SEQ ID NO: 1403737 - DNA, 22 bp, Artificial Sequence
  chemically synthesized
gcttagctcttctggagggagc

SEQ ID NO: 1403738 - DNA, 22 bp, Artificial Sequence
  chemically synthesized
tgcttagctcttctggagggag

SEQ ID NO: 1403739 - DNA, 22 bp, Artificial Sequence
  chemically synthesized
aacttgagtagctccctccaga

SEQ ID NO: 1403740 - DNA, 22 bp, Artificial Sequence
  chemically synthesized
ccctttgcttagctcttctgga

SEQ ID NO: 1403741 - DNA, 22 bp, Artificial Sequence
  chemically synthesized
gagtagctccctccagaagagc

SEQ ID NO: 1403742 - DNA, 22 bp, Artificial Sequence
  chemically synthesized
accctttgcttagctcttctgg

SEQ ID NO: 1403743 - DNA, 22 bp, Artificial Sequence
  chemically synthesized
agtagctccctccagaagagct

SEQ ID NO: 1403744 - DNA, 22 bp, Artificial Sequence
  chemically synthesized
taccctttgcttagctcttctg

SEQ ID NO: 1403745 - DNA, 22 bp, Artificial Sequence
  chemically synthesized
ttaccctttgcttagctcttct

SEQ ID NO: 1403746 - DNA, 22 bp, Artificial Sequence
  chemically synthesized
tttaccctttgcttagctcttc

SEQ ID NO: 1403747 - DNA, 22 bp, Artificial Sequence
  chemically synthesized
ttttaccctttgcttagctctt

SEQ ID NO: 1403748 - DNA, 22 bp, Artificial Sequence
  chemically synthesized
tttttaccctttgcttagctct

SEQ ID NO: 1403749 - DNA, 22 bp, Artificial Sequence
  chemically synthesized
ttttttaccctttgcttagctc

SEQ ID NO: 1403750 - DNA, 22 bp, Artificial Sequence
  chemically synthesized
tttttttaccctttgcttagct

SEQ ID NO: 1403751 - DNA, 22 bp, Artificial Sequence
  chemically synthesized
ttttttttaccctttgcttagc

SEQ ID NO: 1403752 - DNA, 22 bp, Artificial Sequence
  chemically synthesized
cctccagaagagctaagcaaag

SEQ ID NO: 1403753 - DNA, 22 bp, Artificial Sequence
  chemically synthesized
tttttttttaccctttgcttag

SEQ ID NO: 1403754 - DNA, 22 bp, Artificial Sequence
  chemically synthesized
ttttttttttaccctttgctta

SEQ ID NO: 1403755 - DNA, 22 bp, Artificial Sequence
  chemically synthesized
tttttttttttaccctttgctt

SEQ ID NO: 1403756 - DNA, 22 bp, Artificial Sequence
  chemically synthesized
cagaagagctaagcaaagggta

SEQ ID NO: 1403757 - DNA, 22 bp, Artificial Sequence
  chemically synthesized
tttttttttttttaccctttgc

SEQ ID NO: 1403758 - DNA, 22 bp, Artificial Sequence
  chemically synthesized
ttctttttttttttttaccctt

SEQ ID NO: 1403759 - DNA, 22 bp, Artificial Sequence
  chemically synthesized
tattctttttttttttttaccc

SEQ ID NO: 1403760 - DNA, 22 bp, Artificial Sequence
  chemically synthesized
tctattctttttttttttttac

SEQ ID NO: 1403761 - DNA, 22 bp, Artificial Sequence
  chemically synthesized
agcaaagggtaaaaaaaaaaaa

SEQ ID NO: 1403762 - DNA, 22 bp, Artificial Sequence
  chemically synthesized
agggccatgaattctctattct

SEQ ID NO: 1403763 - DNA, 22 bp, Artificial Sequence
  chemically synthesized
gtgcctgagggccatgaattct

SEQ ID NO: 1403764 - DNA, 22 bp, Artificial Sequence
  chemically synthesized
ttagtgcctgagggccatgaat

SEQ ID NO: 1403765 - DNA, 22 bp, Artificial Sequence
  chemically synthesized
ataaactattagtgcctgaggg

SEQ ID NO: 1403766 - DNA, 22 bp, Artificial Sequence
  chemically synthesized
ttcataaactattagtgcctga

SEQ ID NO: 1403767 - DNA, 22 bp, Artificial Sequence
  chemically synthesized
attcataaactattagtgcctg

SEQ ID NO: 1403768 - DNA, 22 bp, Artificial Sequence
  chemically synthesized
atggccctcaggcactaatagt

SEQ ID NO: 1403769 - DNA, 22 bp, Artificial Sequence
  chemically synthesized
atttattcataaactattagtg

SEQ ID NO: 1403770 - DNA, 22 bp, Artificial Sequence
  chemically synthesized
ttgatttattcataaactatta

SEQ ID NO: 1403771 - DNA, 22 bp, Artificial Sequence
  chemically synthesized
aggcactaatagtttatgaata

SEQ ID NO: 1403772 - DNA, 22 bp, Artificial Sequence
  chemically synthesized
aggttattgatttattcataaa

SEQ ID NO: 1403773 - DNA, 22 bp, Artificial Sequence
  chemically synthesized
caggttattgatttattcataa

SEQ ID NO: 1403774 - DNA, 22 bp, Artificial Sequence
  chemically synthesized
tcaggttattgatttattcata

SEQ ID NO: 1403775 - DNA, 22 bp, Artificial Sequence
  chemically synthesized
ttcaggttattgatttattcat

SEQ ID NO: 1403776 - DNA, 22 bp, Artificial Sequence
  chemically synthesized
atagtttatgaataaatcaata

SEQ ID NO: 1403777 - DNA, 22 bp, Artificial Sequence
  chemically synthesized
tgatgtacttttcaggttattg

SEQ ID NO: 1403778 - DNA, 22 bp, Artificial Sequence
  chemically synthesized
atgaataaatcaataacctgaa

SEQ ID NO: 1403779 - DNA, 22 bp, Artificial Sequence
  chemically synthesized
tgaataaatcaataacctgaaa

SEQ ID NO: 1403780 - DNA, 22 bp, Artificial Sequence
  chemically synthesized
ctgtgatgtacttttcaggtta

SEQ ID NO: 1403781 - DNA, 22 bp, Artificial Sequence
  chemically synthesized
gctgtgatgtacttttcaggtt

SEQ ID NO: 1403782 - DNA, 22 bp, Artificial Sequence
  chemically synthesized
tgctgtgatgtacttttcaggt

SEQ ID NO: 1403783 - DNA, 22 bp, Artificial Sequence
  chemically synthesized
ttttgctgtgatgtacttttca

SEQ ID NO: 1403784 - DNA, 22 bp, Artificial Sequence
  chemically synthesized
attttgctgtgatgtacttttc

SEQ ID NO: 1403785 - DNA, 22 bp, Artificial Sequence
  chemically synthesized
accacttattttgctgtgatgt

SEQ ID NO: 1403786 - DNA, 22 bp, Artificial Sequence
  chemically synthesized
caccacttattttgctgtgatg

SEQ ID NO: 1403787 - DNA, 22 bp, Artificial Sequence
  chemically synthesized
tttcaccacttattttgctgtg

SEQ ID NO: 1403788 - DNA, 22 bp, Artificial Sequence
  chemically synthesized
gtttcaccacttattttgctgt

SEQ ID NO: 1403789 - DNA, 22 bp, Artificial Sequence
  chemically synthesized
aaaagtacatcacagcaaaata

SEQ ID NO: 1403790 - DNA, 22 bp, Artificial Sequence
  chemically synthesized
atacttgtttcaccacttattt

SEQ ID NO: 1403791 - DNA, 22 bp, Artificial Sequence
  chemically synthesized
ctaatacttgtttcaccactta

SEQ ID NO: 1403792 - DNA, 22 bp, Artificial Sequence
  chemically synthesized
cctaatacttgtttcaccactt

SEQ ID NO: 1403793 - DNA, 22 bp, Artificial Sequence
  chemically synthesized
tgcatagaatcttcctaatact

SEQ ID NO: 1403794 - DNA, 22 bp, Artificial Sequence
  chemically synthesized
aatcatgcacccctgtgcatag

SEQ ID NO: 1403795 - DNA, 22 bp, Artificial Sequence
  chemically synthesized
ggaagattctatgcacaggggt

SEQ ID NO: 1403796 - DNA, 22 bp, Artificial Sequence
  chemically synthesized
gctgaatcatgcacccctgtgc

SEQ ID NO: 1403797 - DNA, 22 bp, Artificial Sequence
  chemically synthesized
ggctgaatcatgcacccctgtg

SEQ ID NO: 1403798 - DNA, 22 bp, Artificial Sequence
  chemically synthesized
tggctgaatcatgcacccctgt

SEQ ID NO: 1403799 - DNA, 22 bp, Artificial Sequence
  chemically synthesized
ttggctgaatcatgcacccctg

SEQ ID NO: 1403800 - DNA, 22 bp, Artificial Sequence
  chemically synthesized
cttttggctgaatcatgcaccc

SEQ ID NO: 1403801 - DNA, 22 bp, Artificial Sequence
  chemically synthesized
acttttggctgaatcatgcacc

SEQ ID NO: 1403802 - DNA, 22 bp, Artificial Sequence
  chemically synthesized
tacttttggctgaatcatgcac

SEQ ID NO: 1403803 - DNA, 22 bp, Artificial Sequence
  chemically synthesized
tatgcacaggggtgcatgattc

SEQ ID NO: 1403804 - DNA, 22 bp, Artificial Sequence
  chemically synthesized
tttacttttggctgaatcatgc

SEQ ID NO: 1403805 - DNA, 22 bp, Artificial Sequence
  chemically synthesized
tgcacaggggtgcatgattcag

SEQ ID NO: 1403806 - DNA, 22 bp, Artificial Sequence
  chemically synthesized
ctttacttttggctgaatcatg

SEQ ID NO: 1403807 - DNA, 22 bp, Artificial Sequence
  chemically synthesized
ttctttacttttggctgaatca

SEQ ID NO: 1403808 - DNA, 22 bp, Artificial Sequence
  chemically synthesized
gtgcctcttctttacttttggc

SEQ ID NO: 1403809 - DNA, 22 bp, Artificial Sequence
  chemically synthesized
agccaaaagtaaagaagaggca

SEQ ID NO: 1403810 - DNA, 22 bp, Artificial Sequence
  chemically synthesized
caaaatagtgtagctagtgcct

SEQ ID NO: 1403811 - DNA, 22 bp, Artificial Sequence
  chemically synthesized
taatcctccaaaatagtgtagc

SEQ ID NO: 1403812 - DNA, 22 bp, Artificial Sequence
  chemically synthesized
ataatcctccaaaatagtgtag

SEQ ID NO: 1403813 - DNA, 22 bp, Artificial Sequence
  chemically synthesized
tataatcctccaaaatagtgta

SEQ ID NO: 1403814 - DNA, 22 bp, Artificial Sequence
  chemically synthesized
gctacactattttggaggatta

SEQ ID NO: 1403815 - DNA, 22 bp, Artificial Sequence
  chemically synthesized
gtacatgctttataatcctcca

SEQ ID NO: 1403816 - DNA, 22 bp, Artificial Sequence
  chemically synthesized
ggtacatgctttataatcctcc

SEQ ID NO: 1403817 - DNA, 22 bp, Artificial Sequence
  chemically synthesized
cactattttggaggattataaa

SEQ ID NO: 1403818 - DNA, 22 bp, Artificial Sequence
  chemically synthesized
cttggtacatgctttataatcc

SEQ ID NO: 1403819 - DNA, 22 bp, Artificial Sequence
  chemically synthesized
acttggtacatgctttataatc

SEQ ID NO: 1403820 - DNA, 22 bp, Artificial Sequence
  chemically synthesized
ttttggaggattataaagcatg

SEQ ID NO: 1403821 - DNA, 22 bp, Artificial Sequence
  chemically synthesized
tggaggattataaagcatgtac

SEQ ID NO: 1403822 - DNA, 22 bp, Artificial Sequence
  chemically synthesized
ggaggattataaagcatgtacc

SEQ ID NO: 1403823 - DNA, 22 bp, Artificial Sequence
  chemically synthesized
gaggattataaagcatgtacca

SEQ ID NO: 1403824 - DNA, 22 bp, Artificial Sequence
  chemically synthesized
acatatatttacttggtacatg

SEQ ID NO: 1403825 - DNA, 22 bp, Artificial Sequence
  chemically synthesized
ttcacatatatttacttggtac

SEQ ID NO: 1403826 - DNA, 22 bp, Artificial Sequence
  chemically synthesized
attcacatatatttacttggta

SEQ ID NO: 1403827 - DNA, 22 bp, Artificial Sequence
  chemically synthesized
ttattcacatatatttacttgg

SEQ ID NO: 1403828 - DNA, 22 bp, Artificial Sequence
  chemically synthesized
taaagcatgtaccaagtaaata

SEQ ID NO: 1403829 - DNA, 22 bp, Artificial Sequence
  chemically synthesized
catcccacagtcataaacaatt

SEQ ID NO: 1403830 - DNA, 22 bp, Artificial Sequence
  chemically synthesized
actccatcccacagtcataaac

SEQ ID NO: 1403831 - DNA, 22 bp, Artificial Sequence
  chemically synthesized
gaaatgttgactccatcccaca

SEQ ID NO: 1403832 - DNA, 22 bp, Artificial Sequence
  chemically synthesized
ggaaatgttgactccatcccac

SEQ ID NO: 1403833 - DNA, 22 bp, Artificial Sequence
  chemically synthesized
tggaaatgttgactccatccca

SEQ ID NO: 1403834 - DNA, 22 bp, Artificial Sequence
  chemically synthesized
tttatgactgtgggatggagtc

SEQ ID NO: 1403835 - DNA, 22 bp, Artificial Sequence
  chemically synthesized
atgactgtgggatggagtcaac

SEQ ID NO: 1403836 - DNA, 22 bp, Artificial Sequence
  chemically synthesized
tgactgtgggatggagtcaaca

SEQ ID NO: 1403837 - DNA, 22 bp, Artificial Sequence
  chemically synthesized
atgtgcctttggaaatgttgac

SEQ ID NO: 1403838 - DNA, 22 bp, Artificial Sequence
  chemically synthesized
catgtgcctttggaaatgttga

SEQ ID NO: 1403839 - DNA, 22 bp, Artificial Sequence
  chemically synthesized
tcatgtgcctttggaaatgttg

SEQ ID NO: 1403840 - DNA, 22 bp, Artificial Sequence
  chemically synthesized
tgggatggagtcaacatttcca

SEQ ID NO: 1403841 - DNA, 22 bp, Artificial Sequence
  chemically synthesized
ttcatgtgcctttggaaatgtt

SEQ ID NO: 1403842 - DNA, 22 bp, Artificial Sequence
  chemically synthesized
cttttcatgtgcctttggaaat

SEQ ID NO: 1403843 - DNA, 22 bp, Artificial Sequence
  chemically synthesized
ccttttcatgtgcctttggaaa

SEQ ID NO: 1403844 - DNA, 22 bp, Artificial Sequence
  chemically synthesized
taacacacttccttttcatgtg

SEQ ID NO: 1403845 - DNA, 22 bp, Artificial Sequence
  chemically synthesized
actgtaacacacttccttttca

SEQ ID NO: 1403846 - DNA, 22 bp, Artificial Sequence
  chemically synthesized
ccaaaggcacatgaaaaggaag

SEQ ID NO: 1403847 - DNA, 22 bp, Artificial Sequence
  chemically synthesized
caaaggcacatgaaaaggaagt

SEQ ID NO: 1403848 - DNA, 22 bp, Artificial Sequence
  chemically synthesized
tgactgtaacacacttcctttt

SEQ ID NO: 1403849 - DNA, 22 bp, Artificial Sequence
  chemically synthesized
tctgactgtaacacacttcctt

SEQ ID NO: 1403850 - DNA, 22 bp, Artificial Sequence
  chemically synthesized
gccatacaaacagttctctgac

SEQ ID NO: 1403851 - DNA, 22 bp, Artificial Sequence
  chemically synthesized
accctagccatacaaacagttc

SEQ ID NO: 1403852 - DNA, 22 bp, Artificial Sequence
  chemically synthesized
cagtcagagaactgtttgtatg

SEQ ID NO: 1403853 - DNA, 22 bp, Artificial Sequence
  chemically synthesized
tttgtatggctagggtgaggca

SEQ ID NO: 1403854 - DNA, 22 bp, Artificial Sequence
  chemically synthesized
gtatggctagggtgaggcattc

SEQ ID NO: 1403855 - DNA, 22 bp, Artificial Sequence
  chemically synthesized
tatccaccatgtgaatgcctca

SEQ ID NO: 1403856 - DNA, 22 bp, Artificial Sequence
  chemically synthesized
tatggctagggtgaggcattca

SEQ ID NO: 1403857 - DNA, 22 bp, Artificial Sequence
  chemically synthesized
atatccaccatgtgaatgcctc

SEQ ID NO: 1403858 - DNA, 22 bp, Artificial Sequence
  chemically synthesized
atcttatatccaccatgtgaat

SEQ ID NO: 1403859 - DNA, 22 bp, Artificial Sequence
  chemically synthesized
gggtgaggcattcacatggtgg

SEQ ID NO: 1403860 - DNA, 22 bp, Artificial Sequence
  chemically synthesized
agtctaatcttatatccaccat

SEQ ID NO: 1403861 - DNA, 22 bp, Artificial Sequence
  chemically synthesized
acatggtggatataagattaga

SEQ ID NO: 1403862 - DNA, 22 bp, Artificial Sequence
  chemically synthesized
ccatgtgctcagtctaatctta

SEQ ID NO: 1403863 - DNA, 22 bp, Artificial Sequence
  chemically synthesized
cctgccatgtgctcagtctaat

SEQ ID NO: 1403864 - DNA, 22 bp, Artificial Sequence
  chemically synthesized
ccctgccatgtgctcagtctaa

SEQ ID NO: 1403865 - DNA, 22 bp, Artificial Sequence
  chemically synthesized
caacaatttccctgccatgtgc

SEQ ID NO: 1403866 - DNA, 22 bp, Artificial Sequence
  chemically synthesized
acaacaatttccctgccatgtg

SEQ ID NO: 1403867 - DNA, 22 bp, Artificial Sequence
  chemically synthesized
tacaacaatttccctgccatgt

SEQ ID NO: 1403868 - DNA, 22 bp, Artificial Sequence
  chemically synthesized
gactgagcacatggcagggaaa

SEQ ID NO: 1403869 - DNA, 22 bp, Artificial Sequence
  chemically synthesized
agcacatggcagggaaattgtt

SEQ ID NO: 1403870 - DNA, 22 bp, Artificial Sequence
  chemically synthesized
catgaagagaaggtactttaca

SEQ ID NO: 1403871 - DNA, 22 bp, Artificial Sequence
  chemically synthesized
gcatgaagagaaggtactttac

SEQ ID NO: 1403872 - DNA, 22 bp, Artificial Sequence
  chemically synthesized
aaataacttgcatgaagagaag

SEQ ID NO: 1403873 - DNA, 22 bp, Artificial Sequence
  chemically synthesized
ttgtaaagtaccttctcttcat

SEQ ID NO: 1403874 - DNA, 22 bp, Artificial Sequence
  chemically synthesized
taaagtaccttctcttcatgca

SEQ ID NO: 1403875 - DNA, 22 bp, Artificial Sequence
  chemically synthesized
taattcaaataacttgcatgaa

SEQ ID NO: 1403876 - DNA, 22 bp, Artificial Sequence
  chemically synthesized
tagattataattcaaataactt

SEQ ID NO: 1403877 - DNA, 22 bp, Artificial Sequence
  chemically synthesized
atagattataattcaaataact

SEQ ID NO: 1403878 - DNA, 22 bp, Artificial Sequence
  chemically synthesized
ctcttcatgcaagttatttgaa

SEQ ID NO: 1403879 - DNA, 22 bp, Artificial Sequence
  chemically synthesized
tcttcatgcaagttatttgaat

SEQ ID NO: 1403880 - DNA, 22 bp, Artificial Sequence
  chemically synthesized
tttatagattataattcaaata

SEQ ID NO: 1403881 - DNA, 22 bp, Artificial Sequence
  chemically synthesized
ttcatgcaagttatttgaatta

SEQ ID NO: 1403882 - DNA, 22 bp, Artificial Sequence
  chemically synthesized
catgcaagttatttgaattata

SEQ ID NO: 1403883 - DNA, 22 bp, Artificial Sequence
  chemically synthesized
atgcaagttatttgaattataa

SEQ ID NO: 1403884 - DNA, 22 bp, Artificial Sequence
  chemically synthesized
tattatttatagattataattc

SEQ ID NO: 1403885 - DNA, 22 bp, Artificial Sequence
  chemically synthesized
atattatttatagattataatt

SEQ ID NO: 1403886 - DNA, 22 bp, Artificial Sequence
  chemically synthesized
tatattatttatagattataat

SEQ ID NO: 1403887 - DNA, 22 bp, Artificial Sequence
  chemically synthesized
tttgaattataatctataaata

SEQ ID NO: 1403888 - DNA, 22 bp, Artificial Sequence
  chemically synthesized
gaattataatctataaataata

SEQ ID NO: 1403889 - DNA, 22 bp, Artificial Sequence
  chemically synthesized
aattataatctataaataatat

SEQ ID NO: 1403890 - DNA, 22 bp, Artificial Sequence
  chemically synthesized
taatctataaataatataaagc

SEQ ID NO: 1403891 - DNA, 22 bp, Artificial Sequence
  chemically synthesized
aagtccacaggtggctttatat

SEQ ID NO: 1403892 - DNA, 22 bp, Artificial Sequence
  chemically synthesized
aaagtccacaggtggctttata

SEQ ID NO: 1403893 - DNA, 22 bp, Artificial Sequence
  chemically synthesized
cttaaagtccacaggtggcttt

SEQ ID NO: 1403894 - DNA, 22 bp, Artificial Sequence
  chemically synthesized
taaataatataaagccacctgt

SEQ ID NO: 1403895 - DNA, 22 bp, Artificial Sequence
  chemically synthesized
cactgcttaaagtccacaggtg

SEQ ID NO: 1403896 - DNA, 22 bp, Artificial Sequence
  chemically synthesized
ttccactgcttaaagtccacag

SEQ ID NO: 1403897 - DNA, 22 bp, Artificial Sequence
  chemically synthesized
ataagttattccactgcttaaa

SEQ ID NO: 1403898 - DNA, 22 bp, Artificial Sequence
  chemically synthesized
aataagttattccactgcttaa

SEQ ID NO: 1403899 - DNA, 22 bp, Artificial Sequence
  chemically synthesized
tggactttaagcagtggaataa

SEQ ID NO: 1403900 - DNA, 22 bp, Artificial Sequence
  chemically synthesized
taagcagtggaataacttatta

SEQ ID NO: 1403901 - DNA, 22 bp, Artificial Sequence
  chemically synthesized
aaagacaaaacttaataagtta

SEQ ID NO: 1403902 - DNA, 22 bp, Artificial Sequence
  chemically synthesized
aagcagtggaataacttattaa

SEQ ID NO: 1403903 - DNA, 22 bp, Artificial Sequence
  chemically synthesized
agcagtggaataacttattaag

SEQ ID NO: 1403904 - DNA, 22 bp, Artificial Sequence
  chemically synthesized
tcaaagacaaaacttaataagt

SEQ ID NO: 1403905 - DNA, 22 bp, Artificial Sequence
  chemically synthesized
tctcaaagacaaaacttaataa

SEQ ID NO: 1403906 - DNA, 22 bp, Artificial Sequence
  chemically synthesized
tctctctcaaagacaaaactta

SEQ ID NO: 1403907 - DNA, 22 bp, Artificial Sequence
  chemically synthesized
atctctctcaaagacaaaactt

SEQ ID NO: 1403908 - DNA, 22 bp, Artificial Sequence
  chemically synthesized
ggcttatctctctcaaagacaa

SEQ ID NO: 1403909 - DNA, 22 bp, Artificial Sequence
  chemically synthesized
ctaggcttatctctctcaaaga

SEQ ID NO: 1403910 - DNA, 22 bp, Artificial Sequence
  chemically synthesized
attaagttttgtctttgagaga

SEQ ID NO: 1403911 - DNA, 22 bp, Artificial Sequence
  chemically synthesized
ttaagttttgtctttgagagag

SEQ ID NO: 1403912 - DNA, 22 bp, Artificial Sequence
  chemically synthesized
agttttgtctttgagagagata

SEQ ID NO: 1403913 - DNA, 22 bp, Artificial Sequence
  chemically synthesized
acaaggctgctaggcttatctc

SEQ ID NO: 1403914 - DNA, 22 bp, Artificial Sequence
  chemically synthesized
tgtctttgagagagataagcct

SEQ ID NO: 1403915 - DNA, 22 bp, Artificial Sequence
  chemically synthesized
cacaaggctgctaggcttatct

SEQ ID NO: 1403916 - DNA, 22 bp, Artificial Sequence
  chemically synthesized
gtctttgagagagataagccta

SEQ ID NO: 1403917 - DNA, 22 bp, Artificial Sequence
  chemically synthesized
tctttgagagagataagcctag

SEQ ID NO: 1403918 - DNA, 22 bp, Artificial Sequence
  chemically synthesized
cccttcacaaggctgctaggct

SEQ ID NO: 1403919 - DNA, 22 bp, Artificial Sequence
  chemically synthesized
tgagagagataagcctagcagc

SEQ ID NO: 1403920 - DNA, 22 bp, Artificial Sequence
  chemically synthesized
acccttcacaaggctgctaggc

SEQ ID NO: 1403921 - DNA, 22 bp, Artificial Sequence
  chemically synthesized
gagagagataagcctagcagcc

SEQ ID NO: 1403922 - DNA, 22 bp, Artificial Sequence
  chemically synthesized
agagagataagcctagcagcct

SEQ ID NO: 1403923 - DNA, 22 bp, Artificial Sequence
  chemically synthesized
cagtttacccttcacaaggctg

SEQ ID NO: 1403924 - DNA, 22 bp, Artificial Sequence
  chemically synthesized
tccagtttacccttcacaaggc

SEQ ID NO: 1403925 - DNA, 22 bp, Artificial Sequence
  chemically synthesized
tctccagtttacccttcacaag

SEQ ID NO: 1403926 - DNA, 22 bp, Artificial Sequence
  chemically synthesized
ctctccagtttacccttcacaa

SEQ ID NO: 1403927 - DNA, 22 bp, Artificial Sequence
  chemically synthesized
cttctctccagtttacccttca

SEQ ID NO: 1403928 - DNA, 22 bp, Artificial Sequence
  chemically synthesized
gcttctctccagtttacccttc

SEQ ID NO: 1403929 - DNA, 22 bp, Artificial Sequence
  chemically synthesized
gcagccttgtgaagggtaaact

SEQ ID NO: 1403930 - DNA, 22 bp, Artificial Sequence
  chemically synthesized
ttgcttctctccagtttaccct

SEQ ID NO: 1403931 - DNA, 22 bp, Artificial Sequence
  chemically synthesized
cttgcttctctccagtttaccc

SEQ ID NO: 1403932 - DNA, 22 bp, Artificial Sequence
  chemically synthesized
cttcttgcttctctccagttta

SEQ ID NO: 1403933 - DNA, 22 bp, Artificial Sequence
  chemically synthesized
ccttcttgcttctctccagttt

SEQ ID NO: 1403934 - DNA, 22 bp, Artificial Sequence
  chemically synthesized
gtgaagggtaaactggagagaa

SEQ ID NO: 1403935 - DNA, 22 bp, Artificial Sequence
  chemically synthesized
tgaagggtaaactggagagaag

SEQ ID NO: 1403936 - DNA, 22 bp, Artificial Sequence
  chemically synthesized
atgtaccttccttcttgcttct

SEQ ID NO: 1403937 - DNA, 22 bp, Artificial Sequence
  chemically synthesized
ctaatgtaccttccttcttgct

SEQ ID NO: 1403938 - DNA, 22 bp, Artificial Sequence
  chemically synthesized
cctaatgtaccttccttcttgc

SEQ ID NO: 1403939 - DNA, 22 bp, Artificial Sequence
  chemically synthesized
gagagaagcaagaaggaaggta

SEQ ID NO: 1403940 - DNA, 22 bp, Artificial Sequence
  chemically synthesized
atagcttcctaatgtaccttcc

SEQ ID NO: 1403941 - DNA, 22 bp, Artificial Sequence
  chemically synthesized
gaatacactgatagcttcctaa

SEQ ID NO: 1403942 - DNA, 22 bp, Artificial Sequence
  chemically synthesized
cgaatacactgatagcttccta

SEQ ID NO: 1403943 - DNA, 22 bp, Artificial Sequence
  chemically synthesized
acttcgaatacactgatagctt

SEQ ID NO: 1403944 - DNA, 22 bp, Artificial Sequence
  chemically synthesized
ggaagctatcagtgtattcgaa

SEQ ID NO: 1403945 - DNA, 22 bp, Artificial Sequence
  chemically synthesized
gatccccatatctgacttcgaa

SEQ ID NO: 1403946 - DNA, 22 bp, Artificial Sequence
  chemically synthesized
agatccccatatctgacttcga

SEQ ID NO: 1403947 - DNA, 22 bp, Artificial Sequence
  chemically synthesized
tcagtgtattcgaagtcagata

SEQ ID NO: 1403948 - DNA, 22 bp, Artificial Sequence
  chemically synthesized
gtttagatccccatatctgact

SEQ ID NO: 1403949 - DNA, 22 bp, Artificial Sequence
  chemically synthesized
agtttagatccccatatctgac

SEQ ID NO: 1403950 - DNA, 22 bp, Artificial Sequence
  chemically synthesized
gaagtcagatatggggatctaa

SEQ ID NO: 1403951 - DNA, 22 bp, Artificial Sequence
  chemically synthesized
acagtcaccaccttagtttaga

SEQ ID NO: 1403952 - DNA, 22 bp, Artificial Sequence
  chemically synthesized
ctgacagtcaccaccttagttt

SEQ ID NO: 1403953 - DNA, 22 bp, Artificial Sequence
  chemically synthesized
catatctcctgacagtcaccac

SEQ ID NO: 1403954 - DNA, 22 bp, Artificial Sequence
  chemically synthesized
aactaaggtggtgactgtcagg

SEQ ID NO: 1403955 - DNA, 22 bp, Artificial Sequence
  chemically synthesized
aggtggtgactgtcaggagata

SEQ ID NO: 1403956 - DNA, 22 bp, Artificial Sequence
  chemically synthesized
ccatcccccctccatatctcct

SEQ ID NO: 1403957 - DNA, 22 bp, Artificial Sequence
  chemically synthesized
tgccatcccccctccatatctc

SEQ ID NO: 1403958 - DNA, 22 bp, Artificial Sequence
  chemically synthesized
gctctgccatcccccctccata

SEQ ID NO: 1403959 - DNA, 22 bp, Artificial Sequence
  chemically synthesized
agctctgccatcccccctccat

SEQ ID NO: 1403960 - DNA, 22 bp, Artificial Sequence
  chemically synthesized
tagctctgccatcccccctcca

SEQ ID NO: 1403961 - DNA, 22 bp, Artificial Sequence
  chemically synthesized
ttagctctgccatcccccctcc

SEQ ID NO: 1403962 - DNA, 22 bp, Artificial Sequence
  chemically synthesized
tcaggagatatggaggggggat

SEQ ID NO: 1403963 - DNA, 22 bp, Artificial Sequence
  chemically synthesized
ttttagctctgccatcccccct

SEQ ID NO: 1403964 - DNA, 22 bp, Artificial Sequence
  chemically synthesized
cttttagctctgccatcccccc

SEQ ID NO: 1403965 - DNA, 22 bp, Artificial Sequence
  chemically synthesized
aatttcttttagctctgccatc

SEQ ID NO: 1403966 - DNA, 22 bp, Artificial Sequence
  chemically synthesized
tatcctaaatttcttttagctc

SEQ ID NO: 1403967 - DNA, 22 bp, Artificial Sequence
  chemically synthesized
gtatcctaaatttcttttagct

SEQ ID NO: 1403968 - DNA, 22 bp, Artificial Sequence
  chemically synthesized
tttgtatcctaaatttctttta

SEQ ID NO: 1403969 - DNA, 22 bp, Artificial Sequence
  chemically synthesized
ctatttgtatcctaaatttctt

SEQ ID NO: 1403970 - DNA, 22 bp, Artificial Sequence
  chemically synthesized
tcctatttgtatcctaaatttc

SEQ ID NO: 1403971 - DNA, 22 bp, Artificial Sequence
  chemically synthesized
ctcctatttgtatcctaaattt

SEQ ID NO: 1403972 - DNA, 22 bp, Artificial Sequence
  chemically synthesized
atttctcctatttgtatcctaa

SEQ ID NO: 1403973 - DNA, 22 bp, Artificial Sequence
  chemically synthesized
aaagaaatttaggatacaaata

SEQ ID NO: 1403974 - DNA, 22 bp, Artificial Sequence
  chemically synthesized
aggatacaaataggagaaatta

SEQ ID NO: 1403975 - DNA, 22 bp, Artificial Sequence
  chemically synthesized
ggatacaaataggagaaattag

SEQ ID NO: 1403976 - DNA, 22 bp, Artificial Sequence
  chemically synthesized
tagagagccatgtaactaattt

SEQ ID NO: 1403977 - DNA, 22 bp, Artificial Sequence
  chemically synthesized
atagagagccatgtaactaatt

SEQ ID NO: 1403978 - DNA, 22 bp, Artificial Sequence
  chemically synthesized
tatagagagccatgtaactaat

SEQ ID NO: 1403979 - DNA, 22 bp, Artificial Sequence
  chemically synthesized
tttatagagagccatgtaacta

SEQ ID NO: 1403980 - DNA, 22 bp, Artificial Sequence
  chemically synthesized
ctctttatagagagccatgtaa

SEQ ID NO: 1403981 - DNA, 22 bp, Artificial Sequence
  chemically synthesized
cctctttatagagagccatgta

SEQ ID NO: 1403982 - DNA, 22 bp, Artificial Sequence
  chemically synthesized
tttcctctttatagagagccat

SEQ ID NO: 1403983 - DNA, 22 bp, Artificial Sequence
  chemically synthesized
atttcctctttatagagagcca

SEQ ID NO: 1403984 - DNA, 22 bp, Artificial Sequence
  chemically synthesized
gttacatggctctctataaaga

SEQ ID NO: 1403985 - DNA, 22 bp, Artificial Sequence
  chemically synthesized
catggctctctataaagaggaa

SEQ ID NO: 1403986 - DNA, 22 bp, Artificial Sequence
  chemically synthesized
tctataaagaggaaataagact

SEQ ID NO: 1403987 - DNA, 22 bp, Artificial Sequence
  chemically synthesized
tataaagaggaaataagacttc

SEQ ID NO: 1403988 - DNA, 22 bp, Artificial Sequence
  chemically synthesized
taaagaggaaataagacttcct

SEQ ID NO: 1403989 - DNA, 22 bp, Artificial Sequence
  chemically synthesized
acataggaaccatatgaggtaa

SEQ ID NO: 1403990 - DNA, 22 bp, Artificial Sequence
  chemically synthesized
cctaccttgcttacctcatatg

SEQ ID NO: 1403991 - DNA, 22 bp, Artificial Sequence
  chemically synthesized
ctaccttgcttacctcatatgg

SEQ ID NO: 1403992 - DNA, 22 bp, Artificial Sequence
  chemically synthesized
ttcacataggaaccatatgagg

SEQ ID NO: 1403993 - DNA, 22 bp, Artificial Sequence
  chemically synthesized
attcacataggaaccatatgag

SEQ ID NO: 1403994 - DNA, 22 bp, Artificial Sequence
  chemically synthesized
ccttgcttacctcatatggttc

SEQ ID NO: 1403995 - DNA, 22 bp, Artificial Sequence
  chemically synthesized
atttattcacataggaaccata

SEQ ID NO: 1403996 - DNA, 22 bp, Artificial Sequence
  chemically synthesized
aatttattcacataggaaccat

SEQ ID NO: 1403997 - DNA, 22 bp, Artificial Sequence
  chemically synthesized
gcttacctcatatggttcctat

SEQ ID NO: 1403998 - DNA, 22 bp, Artificial Sequence
  chemically synthesized
cttacctcatatggttcctatg

SEQ ID NO: 1403999 - DNA, 22 bp, Artificial Sequence
  chemically synthesized
acctcatatggttcctatgtga

SEQ ID NO: 1404000 - DNA, 22 bp, Artificial Sequence
  chemically synthesized
cctcatatggttcctatgtgaa

SEQ ID NO: 1404001 - DNA, 22 bp, Artificial Sequence
  chemically synthesized
aagtttaatttattcacatagg

SEQ ID NO: 1404002 - DNA, 22 bp, Artificial Sequence
  chemically synthesized
caagtttaatttattcacatag

SEQ ID NO: 1404003 - DNA, 22 bp, Artificial Sequence
  chemically synthesized
tcaagtttaatttattcacata

SEQ ID NO: 1404004 - DNA, 22 bp, Artificial Sequence
  chemically synthesized
atatggttcctatgtgaataaa

SEQ ID NO: 1404005 - DNA, 22 bp, Artificial Sequence
  chemically synthesized
ctatgtgaataaattaaacttg

SEQ ID NO: 1404006 - DNA, 22 bp, Artificial Sequence
  chemically synthesized
acaaaatactttcaagtttaat

SEQ ID NO: 1404007 - DNA, 22 bp, Artificial Sequence
  chemically synthesized
tgtgaataaattaaacttgaaa

SEQ ID NO: 1404008 - DNA, 22 bp, Artificial Sequence
  chemically synthesized
aaattaacaaaatactttcaag

SEQ ID NO: 1404009 - DNA, 22 bp, Artificial Sequence
  chemically synthesized
aaaattaacaaaatactttcaa

SEQ ID NO: 1404010 - DNA, 22 bp, Artificial Sequence
  chemically synthesized
taaaattaacaaaatactttca

SEQ ID NO: 1404011 - DNA, 22 bp, Artificial Sequence
  chemically synthesized
aacttgaaagtattttgttaat

SEQ ID NO: 1404012 - DNA, 22 bp, Artificial Sequence
  chemically synthesized
gaaagtattttgttaattttaa

SEQ ID NO: 1404013 - DNA, 22 bp, Artificial Sequence
  chemically synthesized
aaagtattttgttaattttaaa

SEQ ID NO: 1404014 - DNA, 22 bp, Artificial Sequence
  chemically synthesized
aatgtataaagctttaaaatta

SEQ ID NO: 1404015 - DNA, 22 bp, Artificial Sequence
  chemically synthesized
aaatgtataaagctttaaaatt

SEQ ID NO: 1404016 - DNA, 22 bp, Artificial Sequence
  chemically synthesized
cttaaatgtataaagctttaaa

SEQ ID NO: 1404017 - DNA, 22 bp, Artificial Sequence
  chemically synthesized
attccttaaatgtataaagctt

SEQ ID NO: 1404018 - DNA, 22 bp, Artificial Sequence
  chemically synthesized
tgttaattttaaagctttatac

SEQ ID NO: 1404019 - DNA, 22 bp, Artificial Sequence
  chemically synthesized
aattccttaaatgtataaagct

SEQ ID NO: 1404020 - DNA, 22 bp, Artificial Sequence
  chemically synthesized
gttaattttaaagctttataca

SEQ ID NO: 1404021 - DNA, 22 bp, Artificial Sequence
  chemically synthesized
ttaattttaaagctttatacat

SEQ ID NO: 1404022 - DNA, 22 bp, Artificial Sequence
  chemically synthesized
attttaaagctttatacattta

SEQ ID NO: 1404023 - DNA, 22 bp, Artificial Sequence
  chemically synthesized
ataatcttaattccttaaatgt

SEQ ID NO: 1404024 - DNA, 22 bp, Artificial Sequence
  chemically synthesized
taaagctttatacatttaagga

SEQ ID NO: 1404025 - DNA, 22 bp, Artificial Sequence
  chemically synthesized
gataatcttaattccttaaatg

SEQ ID NO: 1404026 - DNA, 22 bp, Artificial Sequence
  chemically synthesized
aaagctttatacatttaaggaa

SEQ ID NO: 1404027 - DNA, 22 bp, Artificial Sequence
  chemically synthesized
aagctttatacatttaaggaat

SEQ ID NO: 1404028 - DNA, 22 bp, Artificial Sequence
  chemically synthesized
tatacatttaaggaattaagat

SEQ ID NO: 1404029 - DNA, 22 bp, Artificial Sequence
  chemically synthesized
atacatttaaggaattaagatt

SEQ ID NO: 1404030 - DNA, 22 bp, Artificial Sequence
  chemically synthesized
tacatttaaggaattaagatta

SEQ ID NO: 1404031 - DNA, 22 bp, Artificial Sequence
  chemically synthesized
ataagtacttgataatcttaat

SEQ ID NO: 1404032 - DNA, 22 bp, Artificial Sequence
  chemically synthesized
attcataagtacttgataatct

SEQ ID NO: 1404033 - DNA, 22 bp, Artificial Sequence
  chemically synthesized
aattcataagtacttgataatc

SEQ ID NO: 1404034 - DNA, 22 bp, Artificial Sequence
  chemically synthesized
aaggaattaagattatcaagta

SEQ ID NO: 1404035 - DNA, 22 bp, Artificial Sequence
  chemically synthesized
aggaattaagattatcaagtac

SEQ ID NO: 1404036 - DNA, 22 bp, Artificial Sequence
  chemically synthesized
agattatcaagtacttatgaat

SEQ ID NO: 1404037 - DNA, 22 bp, Artificial Sequence
  chemically synthesized
tcaagtacttatgaattaaatg

SEQ ID NO: 1404038 - DNA, 22 bp, Artificial Sequence
  chemically synthesized
atgaattaaatgtacttgtttt

SEQ ID NO: 1404039 - DNA, 22 bp, Artificial Sequence
  chemically synthesized
tgaattaaatgtacttgtttta

SEQ ID NO: 1404040 - DNA, 22 bp, Artificial Sequence
  chemically synthesized
aatgtacttgttttattgacat

SEQ ID NO: 1404041 - DNA, 22 bp, Artificial Sequence
  chemically synthesized
tatgtgaacaaataggaatgtc

SEQ ID NO: 1404042 - DNA, 22 bp, Artificial Sequence
  chemically synthesized
gttttattgacattcctatttg

SEQ ID NO: 1404043 - DNA, 22 bp, Artificial Sequence
  chemically synthesized
actgtatgtgaacaaataggaa

SEQ ID NO: 1404044 - DNA, 22 bp, Artificial Sequence
  chemically synthesized
ttttattgacattcctatttgt

SEQ ID NO: 1404045 - DNA, 22 bp, Artificial Sequence
  chemically synthesized
cactgtatgtgaacaaatagga

SEQ ID NO: 1404046 - DNA, 22 bp, Artificial Sequence
  chemically synthesized
tattgacattcctatttgttca

SEQ ID NO: 1404047 - DNA, 22 bp, Artificial Sequence
  chemically synthesized
tttcactgtatgtgaacaaata

SEQ ID NO: 1404048 - DNA, 22 bp, Artificial Sequence
  chemically synthesized
attgacattcctatttgttcac

SEQ ID NO: 1404049 - DNA, 22 bp, Artificial Sequence
  chemically synthesized
ttgacattcctatttgttcaca

SEQ ID NO: 1404050 - DNA, 22 bp, Artificial Sequence
  chemically synthesized
acattcctatttgttcacatac

SEQ ID NO: 1404051 - DNA, 22 bp, Artificial Sequence
  chemically synthesized
tagttgtttcactgtatgtgaa

SEQ ID NO: 1404052 - DNA, 22 bp, Artificial Sequence
  chemically synthesized
atagttgtttcactgtatgtga

SEQ ID NO: 1404053 - DNA, 22 bp, Artificial Sequence
  chemically synthesized
ctatttgttcacatacagtgaa

SEQ ID NO: 1404054 - DNA, 22 bp, Artificial Sequence
  chemically synthesized
tttgttcacatacagtgaaaca

SEQ ID NO: 1404055 - DNA, 22 bp, Artificial Sequence
  chemically synthesized
gttcacatacagtgaaacaact

SEQ ID NO: 1404056 - DNA, 22 bp, Artificial Sequence
  chemically synthesized
ttcacatacagtgaaacaacta

SEQ ID NO: 1404057 - DNA, 22 bp, Artificial Sequence
  chemically synthesized
acatacagtgaaacaactataa

SEQ ID NO: 1404058 - DNA, 22 bp, Artificial Sequence
  chemically synthesized
aggagtaagtgaagcaaatgtt

SEQ ID NO: 1404059 - DNA, 22 bp, Artificial Sequence
  chemically synthesized
aaggagtaagtgaagcaaatgt

SEQ ID NO: 1404060 - DNA, 22 bp, Artificial Sequence
  chemically synthesized
ttaaggagtaagtgaagcaaat

SEQ ID NO: 1404061 - DNA, 22 bp, Artificial Sequence
  chemically synthesized
ctcttaaggagtaagtgaagca

SEQ ID NO: 1404062 - DNA, 22 bp, Artificial Sequence
  chemically synthesized
cctcttaaggagtaagtgaagc

SEQ ID NO: 1404063 - DNA, 22 bp, Artificial Sequence
  chemically synthesized
tcctcttaaggagtaagtgaag

SEQ ID NO: 1404064 - DNA, 22 bp, Artificial Sequence
  chemically synthesized
taaacatttgcttcacttactc

SEQ ID NO: 1404065 - DNA, 22 bp, Artificial Sequence
  chemically synthesized
ctttcctcttaaggagtaagtg

SEQ ID NO: 1404066 - DNA, 22 bp, Artificial Sequence
  chemically synthesized
gcttcacttactccttaagagg

SEQ ID NO: 1404067 - DNA, 22 bp, Artificial Sequence
  chemically synthesized
gcatgctactttcctcttaagg

SEQ ID NO: 1404068 - DNA, 22 bp, Artificial Sequence
  chemically synthesized
cttcacttactccttaagagga

SEQ ID NO: 1404069 - DNA, 22 bp, Artificial Sequence
  chemically synthesized
cacttactccttaagaggaaag

SEQ ID NO: 1404070 - DNA, 22 bp, Artificial Sequence
  chemically synthesized
cctagcatgctactttcctctt

SEQ ID NO: 1404071 - DNA, 22 bp, Artificial Sequence
  chemically synthesized
acttactccttaagaggaaagt

SEQ ID NO: 1404072 - DNA, 22 bp, Artificial Sequence
  chemically synthesized
actccttaagaggaaagtagca

SEQ ID NO: 1404073 - DNA, 22 bp, Artificial Sequence
  chemically synthesized
ctccttaagaggaaagtagcat

SEQ ID NO: 1404074 - DNA, 22 bp, Artificial Sequence
  chemically synthesized
cttaagaggaaagtagcatgct

SEQ ID NO: 1404075 - DNA, 22 bp, Artificial Sequence
  chemically synthesized
aagaggaaagtagcatgctagg

SEQ ID NO: 1404076 - DNA, 22 bp, Artificial Sequence
  chemically synthesized
agaggaaagtagcatgctaggt

SEQ ID NO: 1404077 - DNA, 22 bp, Artificial Sequence
  chemically synthesized
aatccagatgagttacctagca

SEQ ID NO: 1404078 - DNA, 22 bp, Artificial Sequence
  chemically synthesized
aaatccagatgagttacctagc

SEQ ID NO: 1404079 - DNA, 22 bp, Artificial Sequence
  chemically synthesized
gaaatttaaatccagatgagtt

SEQ ID NO: 1404080 - DNA, 22 bp, Artificial Sequence
  chemically synthesized
agaaatttaaatccagatgagt

SEQ ID NO: 1404081 - DNA, 22 bp, Artificial Sequence
  chemically synthesized
cacttagaaatttaaatccaga

SEQ ID NO: 1404082 - DNA, 22 bp, Artificial Sequence
  chemically synthesized
ccacttagaaatttaaatccag

SEQ ID NO: 1404083 - DNA, 22 bp, Artificial Sequence
  chemically synthesized
ggtaactcatctggatttaaat

SEQ ID NO: 1404084 - DNA, 22 bp, Artificial Sequence
  chemically synthesized
atctggatttaaatttctaagt

SEQ ID NO: 1404085 - DNA, 22 bp, Artificial Sequence
  chemically synthesized
aatagtacttccacttagaaat

SEQ ID NO: 1404086 - DNA, 22 bp, Artificial Sequence
  chemically synthesized
gatttaaatttctaagtggaag

SEQ ID NO: 1404087 - DNA, 22 bp, Artificial Sequence
  chemically synthesized
aaatttctaagtggaagtacta

SEQ ID NO: 1404088 - DNA, 22 bp, Artificial Sequence
  chemically synthesized
aatttctaagtggaagtactat

SEQ ID NO: 1404089 - DNA, 22 bp, Artificial Sequence
  chemically synthesized
ctaagtggaagtactattgagt

SEQ ID NO: 1404090 - DNA, 22 bp, Artificial Sequence
  chemically synthesized
taagtggaagtactattgagta

SEQ ID NO: 1404091 - DNA, 22 bp, Artificial Sequence
  chemically synthesized
atgcagagtagatactcaatag

SEQ ID NO: 1404092 - DNA, 22 bp, Artificial Sequence
  chemically synthesized
catgcagagtagatactcaata

SEQ ID NO: 1404093 - DNA, 22 bp, Artificial Sequence
  chemically synthesized
agtggaagtactattgagtatc

SEQ ID NO: 1404094 - DNA, 22 bp, Artificial Sequence
  chemically synthesized
gcttcatgcagagtagatactc

SEQ ID NO: 1404095 - DNA, 22 bp, Artificial Sequence
  chemically synthesized
cctagcttcatgcagagtagat

SEQ ID NO: 1404096 - DNA, 22 bp, Artificial Sequence
  chemically synthesized
ccctagcttcatgcagagtaga

SEQ ID NO: 1404097 - DNA, 22 bp, Artificial Sequence
  chemically synthesized
ttgagtatctactctgcatgaa

SEQ ID NO: 1404098 - DNA, 22 bp, Artificial Sequence
  chemically synthesized
agtatctactctgcatgaagct

SEQ ID NO: 1404099 - DNA, 22 bp, Artificial Sequence
  chemically synthesized
ccacacttccctagcttcatgc

SEQ ID NO: 1404100 - DNA, 22 bp, Artificial Sequence
  chemically synthesized
gccacacttccctagcttcatg

SEQ ID NO: 1404101 - DNA, 22 bp, Artificial Sequence
  chemically synthesized
ctctgcatgaagctagggaagt

SEQ ID NO: 1404102 - DNA, 22 bp, Artificial Sequence
  chemically synthesized
tgcatgaagctagggaagtgtg

SEQ ID NO: 1404103 - DNA, 22 bp, Artificial Sequence
  chemically synthesized
gagtccccttgccacacttccc

SEQ ID NO: 1404104 - DNA, 22 bp, Artificial Sequence
  chemically synthesized
catgaagctagggaagtgtggc

SEQ ID NO: 1404105 - DNA, 22 bp, Artificial Sequence
  chemically synthesized
gctagagtccccttgccacact

SEQ ID NO: 1404106 - DNA, 22 bp, Artificial Sequence
  chemically synthesized
ggctagagtccccttgccacac

SEQ ID NO: 1404107 - DNA, 22 bp, Artificial Sequence
  chemically synthesized
gtccttggctagagtccccttg

SEQ ID NO: 1404108 - DNA, 22 bp, Artificial Sequence
  chemically synthesized
gggaagtgtggcaaggggactc

SEQ ID NO: 1404109 - DNA, 22 bp, Artificial Sequence
  chemically synthesized
tagtccttggctagagtcccct

SEQ ID NO: 1404110 - DNA, 22 bp, Artificial Sequence
  chemically synthesized
ctagtccttggctagagtcccc

SEQ ID NO: 1404111 - DNA, 22 bp, Artificial Sequence
  chemically synthesized
tcttctagtccttggctagagt

SEQ ID NO: 1404112 - DNA, 22 bp, Artificial Sequence
  chemically synthesized
tatcttctagtccttggctaga

SEQ ID NO: 1404113 - DNA, 22 bp, Artificial Sequence
  chemically synthesized
tctatcttctagtccttggcta

SEQ ID NO: 1404114 - DNA, 22 bp, Artificial Sequence
  chemically synthesized
agtctctctatcttctagtcct

SEQ ID NO: 1404115 - DNA, 22 bp, Artificial Sequence
  chemically synthesized
tcagtctctctatcttctagtc

SEQ ID NO: 1404116 - DNA, 22 bp, Artificial Sequence
  chemically synthesized
ctctcagtctctctatcttcta

SEQ ID NO: 1404117 - DNA, 22 bp, Artificial Sequence
  chemically synthesized
tagccaaggactagaagataga

SEQ ID NO: 1404118 - DNA, 22 bp, Artificial Sequence
  chemically synthesized
gctctcagtctctctatcttct

SEQ ID NO: 1404119 - DNA, 22 bp, Artificial Sequence
  chemically synthesized
gccaaggactagaagatagaga

SEQ ID NO: 1404120 - DNA, 22 bp, Artificial Sequence
  chemically synthesized
agaaacaacttgctctcagtct

SEQ ID NO: 1404121 - DNA, 22 bp, Artificial Sequence
  chemically synthesized
gaagatagagagactgagagca

SEQ ID NO: 1404122 - DNA, 22 bp, Artificial Sequence
  chemically synthesized
cacagatgcctgagaaacaact

SEQ ID NO: 1404123 - DNA, 22 bp, Artificial Sequence
  chemically synthesized
agagcaagttgtttctcaggca

SEQ ID NO: 1404124 - DNA, 22 bp, Artificial Sequence
  chemically synthesized
gagaagcattccacagatgcct

SEQ ID NO: 1404125 - DNA, 22 bp, Artificial Sequence
  chemically synthesized
attggagaagcattccacagat

SEQ ID NO: 1404126 - DNA, 22 bp, Artificial Sequence
  chemically synthesized
tttctcaggcatctgtggaatg

SEQ ID NO: 1404127 - DNA, 22 bp, Artificial Sequence
  chemically synthesized
ttcattggagaagcattccaca

SEQ ID NO: 1404128 - DNA, 22 bp, Artificial Sequence
  chemically synthesized
gttcattggagaagcattccac

SEQ ID NO: 1404129 - DNA, 22 bp, Artificial Sequence
  chemically synthesized
ctcaggcatctgtggaatgctt

SEQ ID NO: 1404130 - DNA, 22 bp, Artificial Sequence
  chemically synthesized
tcaggcatctgtggaatgcttc

SEQ ID NO: 1404131 - DNA, 22 bp, Artificial Sequence
  chemically synthesized
ttgttcattggagaagcattcc

SEQ ID NO: 1404132 - DNA, 22 bp, Artificial Sequence
  chemically synthesized
cttgttcattggagaagcattc

SEQ ID NO: 1404133 - DNA, 22 bp, Artificial Sequence
  chemically synthesized
aggcatctgtggaatgcttctc

SEQ ID NO: 1404134 - DNA, 22 bp, Artificial Sequence
  chemically synthesized
tcttgttcattggagaagcatt

SEQ ID NO: 1404135 - DNA, 22 bp, Artificial Sequence
  chemically synthesized
tttcttgttcattggagaagca

SEQ ID NO: 1404136 - DNA, 22 bp, Artificial Sequence
  chemically synthesized
tctttcttgttcattggagaag

SEQ ID NO: 1404137 - DNA, 22 bp, Artificial Sequence
  chemically synthesized
ctctttcttgttcattggagaa

SEQ ID NO: 1404138 - DNA, 22 bp, Artificial Sequence
  chemically synthesized
tctctttcttgttcattggaga

SEQ ID NO: 1404139 - DNA, 22 bp, Artificial Sequence
  chemically synthesized
tttctctttcttgttcattgga

SEQ ID NO: 1404140 - DNA, 22 bp, Artificial Sequence
  chemically synthesized
tggaatgcttctccaatgaaca

SEQ ID NO: 1404141 - DNA, 22 bp, Artificial Sequence
  chemically synthesized
ctttctctttcttgttcattgg

SEQ ID NO: 1404142 - DNA, 22 bp, Artificial Sequence
  chemically synthesized
caaatatttctttctctttctt

SEQ ID NO: 1404143 - DNA, 22 bp, Artificial Sequence
  chemically synthesized
ctccaatgaacaagaaagagaa

SEQ ID NO: 1404144 - DNA, 22 bp, Artificial Sequence
  chemically synthesized
tccaatgaacaagaaagagaaa

SEQ ID NO: 1404145 - DNA, 22 bp, Artificial Sequence
  chemically synthesized
caatgaacaagaaagagaaaga

SEQ ID NO: 1404146 - DNA, 22 bp, Artificial Sequence
  chemically synthesized
gttccaaatatttctttctctt

SEQ ID NO: 1404147 - DNA, 22 bp, Artificial Sequence
  chemically synthesized
agttccaaatatttctttctct

SEQ ID NO: 1404148 - DNA, 22 bp, Artificial Sequence
  chemically synthesized
tagttccaaatatttctttctc

SEQ ID NO: 1404149 - DNA, 22 bp, Artificial Sequence
  chemically synthesized
atgcatattttagttccaaata

SEQ ID NO: 1404150 - DNA, 22 bp, Artificial Sequence
  chemically synthesized
tcatgcatattttagttccaaa

SEQ ID NO: 1404151 - DNA, 22 bp, Artificial Sequence
  chemically synthesized
ctcatgcatattttagttccaa

SEQ ID NO: 1404152 - DNA, 22 bp, Artificial Sequence
  chemically synthesized
cttctcatgcatattttagttc

SEQ ID NO: 1404153 - DNA, 22 bp, Artificial Sequence
  chemically synthesized
attacttctcatgcatatttta

SEQ ID NO: 1404154 - DNA, 22 bp, Artificial Sequence
  chemically synthesized
ggaactaaaatatgcatgagaa

SEQ ID NO: 1404155 - DNA, 22 bp, Artificial Sequence
  chemically synthesized
gaactaaaatatgcatgagaag

SEQ ID NO: 1404156 - DNA, 22 bp, Artificial Sequence
  chemically synthesized
caaggttgattacttctcatgc

SEQ ID NO: 1404157 - DNA, 22 bp, Artificial Sequence
  chemically synthesized
ttccaaggttgattacttctca

SEQ ID NO: 1404158 - DNA, 22 bp, Artificial Sequence
  chemically synthesized
aaatatgcatgagaagtaatca

SEQ ID NO: 1404159 - DNA, 22 bp, Artificial Sequence
  chemically synthesized
gcaacctattccaaggttgatt

SEQ ID NO: 1404160 - DNA, 22 bp, Artificial Sequence
  chemically synthesized
agcaacctattccaaggttgat

SEQ ID NO: 1404161 - DNA, 22 bp, Artificial Sequence
  chemically synthesized
tagcaacctattccaaggttga

SEQ ID NO: 1404162 - DNA, 22 bp, Artificial Sequence
  chemically synthesized
ttagcaacctattccaaggttg

SEQ ID NO: 1404163 - DNA, 22 bp, Artificial Sequence
  chemically synthesized
tttagcaacctattccaaggtt

SEQ ID NO: 1404164 - DNA, 22 bp, Artificial Sequence
  chemically synthesized
tttttagcaacctattccaagg

SEQ ID NO: 1404165 - DNA, 22 bp, Artificial Sequence
  chemically synthesized
attctttttagcaacctattcc

SEQ ID NO: 1404166 - DNA, 22 bp, Artificial Sequence
  chemically synthesized
aattctttttagcaacctattc

SEQ ID NO: 1404167 - DNA, 22 bp, Artificial Sequence
  chemically synthesized
taattctttttagcaacctatt

SEQ ID NO: 1404168 - DNA, 22 bp, Artificial Sequence
  chemically synthesized
ttaattctttttagcaacctat

SEQ ID NO: 1404169 - DNA, 22 bp, Artificial Sequence
  chemically synthesized
ggaataggttgctaaaaagaat

SEQ ID NO: 1404170 - DNA, 22 bp, Artificial Sequence
  chemically synthesized
gaataggttgctaaaaagaatt

SEQ ID NO: 1404171 - DNA, 22 bp, Artificial Sequence
  chemically synthesized
taagaatcttttaattcttttt

SEQ ID NO: 1404172 - DNA, 22 bp, Artificial Sequence
  chemically synthesized
ttataagaatcttttaattctt

SEQ ID NO: 1404173 - DNA, 22 bp, Artificial Sequence
  chemically synthesized
attataagaatcttttaattct

SEQ ID NO: 1404174 - DNA, 22 bp, Artificial Sequence
  chemically synthesized
aacttattataagaatctttta

SEQ ID NO: 1404175 - DNA, 22 bp, Artificial Sequence
  chemically synthesized
ctaaaaagaattaaaagattct

SEQ ID NO: 1404176 - DNA, 22 bp, Artificial Sequence
  chemically synthesized
aaaagaattaaaagattcttat

SEQ ID NO: 1404177 - DNA, 22 bp, Artificial Sequence
  chemically synthesized
gagactgaacttattataagaa

SEQ ID NO: 1404178 - DNA, 22 bp, Artificial Sequence
  chemically synthesized
agagactgaacttattataaga

SEQ ID NO: 1404179 - DNA, 22 bp, Artificial Sequence
  chemically synthesized
catttagagactgaacttatta

SEQ ID NO: 1404180 - DNA, 22 bp, Artificial Sequence
  chemically synthesized
aaagattcttataataagttca

SEQ ID NO: 1404181 - DNA, 22 bp, Artificial Sequence
  chemically synthesized
gcatttagagactgaacttatt

SEQ ID NO: 1404182 - DNA, 22 bp, Artificial Sequence
  chemically synthesized
ttgcatttagagactgaactta

SEQ ID NO: 1404183 - DNA, 22 bp, Artificial Sequence
  chemically synthesized
cttgcatttagagactgaactt

SEQ ID NO: 1404184 - DNA, 22 bp, Artificial Sequence
  chemically synthesized
tcttgcatttagagactgaact

SEQ ID NO: 1404185 - DNA, 22 bp, Artificial Sequence
  chemically synthesized
ttcttgcatttagagactgaac

SEQ ID NO: 1404186 - DNA, 22 bp, Artificial Sequence
  chemically synthesized
ttataataagttcagtctctaa

SEQ ID NO: 1404187 - DNA, 22 bp, Artificial Sequence
  chemically synthesized
ataataagttcagtctctaaat

SEQ ID NO: 1404188 - DNA, 22 bp, Artificial Sequence
  chemically synthesized
aacttttcttgcatttagagac

SEQ ID NO: 1404189 - DNA, 22 bp, Artificial Sequence
  chemically synthesized
taataagttcagtctctaaatg

SEQ ID NO: 1404190 - DNA, 22 bp, Artificial Sequence
  chemically synthesized
ctaaacttttcttgcatttaga

SEQ ID NO: 1404191 - DNA, 22 bp, Artificial Sequence
  chemically synthesized
ttactaaacttttcttgcattt

SEQ ID NO: 1404192 - DNA, 22 bp, Artificial Sequence
  chemically synthesized
agtctctaaatgcaagaaaagt

SEQ ID NO: 1404193 - DNA, 22 bp, Artificial Sequence
  chemically synthesized
taaatgcaagaaaagtttagta

SEQ ID NO: 1404194 - DNA, 22 bp, Artificial Sequence
  chemically synthesized
aatgcaagaaaagtttagtaat

SEQ ID NO: 1404195 - DNA, 22 bp, Artificial Sequence
  chemically synthesized
atatccagagaccagattatta

SEQ ID NO: 1404196 - DNA, 22 bp, Artificial Sequence
  chemically synthesized
ggtgagttaatatccagagacc

SEQ ID NO: 1404197 - DNA, 22 bp, Artificial Sequence
  chemically synthesized
agtaataatctggtctctggat

SEQ ID NO: 1404198 - DNA, 22 bp, Artificial Sequence
  chemically synthesized
gtaataatctggtctctggata

SEQ ID NO: 1404199 - DNA, 22 bp, Artificial Sequence
  chemically synthesized
aatacggattaggtgagttaat

SEQ ID NO: 1404200 - DNA, 22 bp, Artificial Sequence
  chemically synthesized
gtctctggatattaactcacct

SEQ ID NO: 1404201 - DNA, 22 bp, Artificial Sequence
  chemically synthesized
tggatattaactcacctaatcc

SEQ ID NO: 1404202 - DNA, 22 bp, Artificial Sequence
  chemically synthesized
gatattaactcacctaatccgt

SEQ ID NO: 1404203 - DNA, 22 bp, Artificial Sequence
  chemically synthesized
atgtgcaacctaaatacggatt

SEQ ID NO: 1404204 - DNA, 22 bp, Artificial Sequence
  chemically synthesized
ttcatgtgcaacctaaatacgg

SEQ ID NO: 1404205 - DNA, 22 bp, Artificial Sequence
  chemically synthesized
actcacctaatccgtatttagg

SEQ ID NO: 1404206 - DNA, 22 bp, Artificial Sequence
  chemically synthesized
attcatgtgcaacctaaatacg

SEQ ID NO: 1404207 - DNA, 22 bp, Artificial Sequence
  chemically synthesized
ttattcatgtgcaacctaaata

SEQ ID NO: 1404208 - DNA, 22 bp, Artificial Sequence
  chemically synthesized
acctaatccgtatttaggttgc

SEQ ID NO: 1404209 - DNA, 22 bp, Artificial Sequence
  chemically synthesized
atccgtatttaggttgcacatg

SEQ ID NO: 1404210 - DNA, 22 bp, Artificial Sequence
  chemically synthesized
aatacggaactcttattcatgt

SEQ ID NO: 1404211 - DNA, 22 bp, Artificial Sequence
  chemically synthesized
taaatacggaactcttattcat

SEQ ID NO: 1404212 - DNA, 22 bp, Artificial Sequence
  chemically synthesized
ctaaatacggaactcttattca

SEQ ID NO: 1404213 - DNA, 22 bp, Artificial Sequence
  chemically synthesized
tctaaatacggaactcttattc

SEQ ID NO: 1404214 - DNA, 22 bp, Artificial Sequence
  chemically synthesized
aggttgcacatgaataagagtt

SEQ ID NO: 1404215 - DNA, 22 bp, Artificial Sequence
  chemically synthesized
ggttgcacatgaataagagttc

SEQ ID NO: 1404216 - DNA, 22 bp, Artificial Sequence
  chemically synthesized
cacatgaataagagttccgtat

SEQ ID NO: 1404217 - DNA, 22 bp, Artificial Sequence
  chemically synthesized
aataaatacaattttctaaata

SEQ ID NO: 1404218 - DNA, 22 bp, Artificial Sequence
  chemically synthesized
tattgaataaatacaattttct

SEQ ID NO: 1404219 - DNA, 22 bp, Artificial Sequence
  chemically synthesized
attgtattgaataaatacaatt

SEQ ID NO: 1404220 - DNA, 22 bp, Artificial Sequence
  chemically synthesized
cgtatttagaaaattgtattta

SEQ ID NO: 1404221 - DNA, 22 bp, Artificial Sequence
  chemically synthesized
ttcattgtattgaataaataca

SEQ ID NO: 1404222 - DNA, 22 bp, Artificial Sequence
  chemically synthesized
attcattgtattgaataaatac

SEQ ID NO: 1404223 - DNA, 22 bp, Artificial Sequence
  chemically synthesized
tattcattgtattgaataaata

SEQ ID NO: 1404224 - DNA, 22 bp, Artificial Sequence
  chemically synthesized
agaaaattgtatttattcaata

SEQ ID NO: 1404225 - DNA, 22 bp, Artificial Sequence
  chemically synthesized
gaaaattgtatttattcaatac

SEQ ID NO: 1404226 - DNA, 22 bp, Artificial Sequence
  chemically synthesized
attttattcattgtattgaata

SEQ ID NO: 1404227 - DNA, 22 bp, Artificial Sequence
  chemically synthesized
gattttattcattgtattgaat

SEQ ID NO: 1404228 - DNA, 22 bp, Artificial Sequence
  chemically synthesized
gccttgattttattcattgtat

SEQ ID NO: 1404229 - DNA, 22 bp, Artificial Sequence
  chemically synthesized
tatttattcaatacaatgaata

SEQ ID NO: 1404230 - DNA, 22 bp, Artificial Sequence
  chemically synthesized
gttggccttgattttattcatt

SEQ ID NO: 1404231 - DNA, 22 bp, Artificial Sequence
  chemically synthesized
cgttggccttgattttattcat

SEQ ID NO: 1404232 - DNA, 22 bp, Artificial Sequence
  chemically synthesized
attcaatacaatgaataaaatc

SEQ ID NO: 1404233 - DNA, 22 bp, Artificial Sequence
  chemically synthesized
ttcaatacaatgaataaaatca

SEQ ID NO: 1404234 - DNA, 22 bp, Artificial Sequence
  chemically synthesized
aatacaatgaataaaatcaagg

SEQ ID NO: 1404235 - DNA, 22 bp, Artificial Sequence
  chemically synthesized
gagaagtcacttcgttggcctt

SEQ ID NO: 1404236 - DNA, 22 bp, Artificial Sequence
  chemically synthesized
caaaacggtaattagagaagtc

SEQ ID NO: 1404237 - DNA, 22 bp, Artificial Sequence
  chemically synthesized
ccaaaacggtaattagagaagt

SEQ ID NO: 1404238 - DNA, 22 bp, Artificial Sequence
  chemically synthesized
tccaaaacggtaattagagaag

SEQ ID NO: 1404239 - DNA, 22 bp, Artificial Sequence
  chemically synthesized
ttccaaaacggtaattagagaa

SEQ ID NO: 1404240 - DNA, 22 bp, Artificial Sequence
  chemically synthesized
tttccaaaacggtaattagaga

SEQ ID NO: 1404241 - DNA, 22 bp, Artificial Sequence
  chemically synthesized
ttttccaaaacggtaattagag

SEQ ID NO: 1404242 - DNA, 22 bp, Artificial Sequence
  chemically synthesized
tttttccaaaacggtaattaga

SEQ ID NO: 1404243 - DNA, 22 bp, Artificial Sequence
  chemically synthesized
ttttttccaaaacggtaattag

SEQ ID NO: 1404244 - DNA, 22 bp, Artificial Sequence
  chemically synthesized
tatcttttttttccaaaacggt

SEQ ID NO: 1404245 - DNA, 22 bp, Artificial Sequence
  chemically synthesized
tgtatcttttttttccaaaacg

SEQ ID NO: 1404246 - DNA, 22 bp, Artificial Sequence
  chemically synthesized
ctgtatcttttttttccaaaac

SEQ ID NO: 1404247 - DNA, 22 bp, Artificial Sequence
  chemically synthesized
ctctaattaccgttttggaaaa

SEQ ID NO: 1404248 - DNA, 22 bp, Artificial Sequence
  chemically synthesized
tctgtatcttttttttccaaaa

SEQ ID NO: 1404249 - DNA, 22 bp, Artificial Sequence
  chemically synthesized
tctaattaccgttttggaaaaa

SEQ ID NO: 1404250 - DNA, 22 bp, Artificial Sequence
  chemically synthesized
taattaccgttttggaaaaaaa

SEQ ID NO: 1404251 - DNA, 22 bp, Artificial Sequence
  chemically synthesized
attttctgtatcttttttttcc

SEQ ID NO: 1404252 - DNA, 22 bp, Artificial Sequence
  chemically synthesized
attaccgttttggaaaaaaaag

SEQ ID NO: 1404253 - DNA, 22 bp, Artificial Sequence
  chemically synthesized
ccgttttggaaaaaaaagatac

SEQ ID NO: 1404254 - DNA, 22 bp, Artificial Sequence
  chemically synthesized
aataattcattttctgtatctt

SEQ ID NO: 1404255 - DNA, 22 bp, Artificial Sequence
  chemically synthesized
tggaaaaaaaagatacagaaaa

SEQ ID NO: 1404256 - DNA, 22 bp, Artificial Sequence
  chemically synthesized
ggaaaaaaaagatacagaaaat

SEQ ID NO: 1404257 - DNA, 22 bp, Artificial Sequence
  chemically synthesized
gaaaaaaaagatacagaaaatg

SEQ ID NO: 1404258 - DNA, 22 bp, Artificial Sequence
  chemically synthesized
caatatcattaaataattcatt

SEQ ID NO: 1404259 - DNA, 22 bp, Artificial Sequence
  chemically synthesized
ccaatatcattaaataattcat

SEQ ID NO: 1404260 - DNA, 22 bp, Artificial Sequence
  chemically synthesized
tccaatatcattaaataattca

SEQ ID NO: 1404261 - DNA, 22 bp, Artificial Sequence
  chemically synthesized
ttccaatatcattaaataattc

SEQ ID NO: 1404262 - DNA, 22 bp, Artificial Sequence
  chemically synthesized
tttccaatatcattaaataatt

SEQ ID NO: 1404263 - DNA, 22 bp, Artificial Sequence
  chemically synthesized
tttttccaatatcattaaataa

SEQ ID NO: 1404264 - DNA, 22 bp, Artificial Sequence
  chemically synthesized
gggataacctctttttccaata

SEQ ID NO: 1404265 - DNA, 22 bp, Artificial Sequence
  chemically synthesized
agggataacctctttttccaat

SEQ ID NO: 1404266 - DNA, 22 bp, Artificial Sequence
  chemically synthesized
tttaatgatattggaaaaagag

SEQ ID NO: 1404267 - DNA, 22 bp, Artificial Sequence
  chemically synthesized
aatgatattggaaaaagaggtt

SEQ ID NO: 1404268 - DNA, 22 bp, Artificial Sequence
  chemically synthesized
atgatattggaaaaagaggtta

SEQ ID NO: 1404269 - DNA, 22 bp, Artificial Sequence
  chemically synthesized
ccatacataggtcttagggata

SEQ ID NO: 1404270 - DNA, 22 bp, Artificial Sequence
  chemically synthesized
gaaaaagaggttatccctaaga

SEQ ID NO: 1404271 - DNA, 22 bp, Artificial Sequence
  chemically synthesized
tgccatacataggtcttaggga

SEQ ID NO: 1404272 - DNA, 22 bp, Artificial Sequence
  chemically synthesized
ctgccatacataggtcttaggg

SEQ ID NO: 1404273 - DNA, 22 bp, Artificial Sequence
  chemically synthesized
ttctgccatacataggtcttag

SEQ ID NO: 1404274 - DNA, 22 bp, Artificial Sequence
  chemically synthesized
gttcttctgccatacataggtc

SEQ ID NO: 1404275 - DNA, 22 bp, Artificial Sequence
  chemically synthesized
agttcttctgccatacataggt

SEQ ID NO: 1404276 - DNA, 22 bp, Artificial Sequence
  chemically synthesized
tagttcttctgccatacatagg

SEQ ID NO: 1404277 - DNA, 22 bp, Artificial Sequence
  chemically synthesized
tccctaagacctatgtatggca

SEQ ID NO: 1404278 - DNA, 22 bp, Artificial Sequence
  chemically synthesized
cctttagttcttctgccataca

SEQ ID NO: 1404279 - DNA, 22 bp, Artificial Sequence
  chemically synthesized
cctgcctttagttcttctgcca

SEQ ID NO: 1404280 - DNA, 22 bp, Artificial Sequence
  chemically synthesized
agacctatgtatggcagaagaa

SEQ ID NO: 1404281 - DNA, 22 bp, Artificial Sequence
  chemically synthesized
tgtatggcagaagaactaaagg

SEQ ID NO: 1404282 - DNA, 22 bp, Artificial Sequence
  chemically synthesized
ggtcactacctgcctttagttc

SEQ ID NO: 1404283 - DNA, 22 bp, Artificial Sequence
  chemically synthesized
gggtcactacctgcctttagtt

SEQ ID NO: 1404284 - DNA, 22 bp, Artificial Sequence
  chemically synthesized
gtgatacagatttgggtcacta

SEQ ID NO: 1404285 - DNA, 22 bp, Artificial Sequence
  chemically synthesized
aaggcaggtagtgacccaaatc

SEQ ID NO: 1404286 - DNA, 22 bp, Artificial Sequence
  chemically synthesized
agttagtgatacagatttgggt

SEQ ID NO: 1404287 - DNA, 22 bp, Artificial Sequence
  chemically synthesized
gaaggaaattgagttagtgata

SEQ ID NO: 1404288 - DNA, 22 bp, Artificial Sequence
  chemically synthesized
ggaaggaaattgagttagtgat

SEQ ID NO: 1404289 - DNA, 22 bp, Artificial Sequence
  chemically synthesized
cttggaaggaaattgagttagt

SEQ ID NO: 1404290 - DNA, 22 bp, Artificial Sequence
  chemically synthesized
tacctgcttggaaggaaattga

SEQ ID NO: 1404291 - DNA, 22 bp, Artificial Sequence
  chemically synthesized
tatcactaactcaatttccttc

SEQ ID NO: 1404292 - DNA, 22 bp, Artificial Sequence
  chemically synthesized
tgtacctgcttggaaggaaatt

SEQ ID NO: 1404293 - DNA, 22 bp, Artificial Sequence
  chemically synthesized
ctgtacctgcttggaaggaaat

SEQ ID NO: 1404294 - DNA, 22 bp, Artificial Sequence
  chemically synthesized
cttctgtacctgcttggaagga

SEQ ID NO: 1404295 - DNA, 22 bp, Artificial Sequence
  chemically synthesized
actcaatttccttccaagcagg

SEQ ID NO: 1404296 - DNA, 22 bp, Artificial Sequence
  chemically synthesized
aatttccttccaagcaggtaca

SEQ ID NO: 1404297 - DNA, 22 bp, Artificial Sequence
  chemically synthesized
catgatctacttctgtacctgc

SEQ ID NO: 1404298 - DNA, 22 bp, Artificial Sequence
  chemically synthesized
ccatgatctacttctgtacctg

SEQ ID NO: 1404299 - DNA, 22 bp, Artificial Sequence
  chemically synthesized
ccttccaagcaggtacagaagt

SEQ ID NO: 1404300 - DNA, 22 bp, Artificial Sequence
  chemically synthesized
cttccatgatctacttctgtac

SEQ ID NO: 1404301 - DNA, 22 bp, Artificial Sequence
  chemically synthesized
cttccaagcaggtacagaagta

SEQ ID NO: 1404302 - DNA, 22 bp, Artificial Sequence
  chemically synthesized
ccaagcaggtacagaagtagat

SEQ ID NO: 1404303 - DNA, 22 bp, Artificial Sequence
  chemically synthesized
actccttccatgatctacttct

SEQ ID NO: 1404304 - DNA, 22 bp, Artificial Sequence
  chemically synthesized
caagcaggtacagaagtagatc

SEQ ID NO: 1404305 - DNA, 22 bp, Artificial Sequence
  chemically synthesized
cactccttccatgatctacttc

SEQ ID NO: 1404306 - DNA, 22 bp, Artificial Sequence
  chemically synthesized
tgcatttcactccttccatgat

SEQ ID NO: 1404307 - DNA, 22 bp, Artificial Sequence
  chemically synthesized
tatgcatttcactccttccatg

SEQ ID NO: 1404308 - DNA, 22 bp, Artificial Sequence
  chemically synthesized
taagattctatgcatttcactc

SEQ ID NO: 1404309 - DNA, 22 bp, Artificial Sequence
  chemically synthesized
ataagattctatgcatttcact

SEQ ID NO: 1404310 - DNA, 22 bp, Artificial Sequence
  chemically synthesized
tataagattctatgcatttcac

SEQ ID NO: 1404311 - DNA, 22 bp, Artificial Sequence
  chemically synthesized
atcagaaccagatctttataag

SEQ ID NO: 1404312 - DNA, 22 bp, Artificial Sequence
  chemically synthesized
taatcagaaccagatctttata

SEQ ID NO: 1404313 - DNA, 22 bp, Artificial Sequence
  chemically synthesized
tgaaacagctctaatcagaacc

SEQ ID NO: 1404314 - DNA, 22 bp, Artificial Sequence
  chemically synthesized
gtgaaacagctctaatcagaac

SEQ ID NO: 1404315 - DNA, 22 bp, Artificial Sequence
  chemically synthesized
ataaagatctggttctgattag

SEQ ID NO: 1404316 - DNA, 22 bp, Artificial Sequence
  chemically synthesized
taaagatctggttctgattaga

SEQ ID NO: 1404317 - DNA, 22 bp, Artificial Sequence
  chemically synthesized
cttgtgaaacagctctaatcag

SEQ ID NO: 1404318 - DNA, 22 bp, Artificial Sequence
  chemically synthesized
agctacttgtgaaacagctcta

SEQ ID NO: 1404319 - DNA, 22 bp, Artificial Sequence
  chemically synthesized
gttctgattagagctgtttcac

SEQ ID NO: 1404320 - DNA, 22 bp, Artificial Sequence
  chemically synthesized
tgattagagctgtttcacaagt

SEQ ID NO: 1404321 - DNA, 22 bp, Artificial Sequence
  chemically synthesized
attagagctgtttcacaagtag

SEQ ID NO: 1404322 - DNA, 22 bp, Artificial Sequence
  chemically synthesized
agtgagattaagctacttgtga

SEQ ID NO: 1404323 - DNA, 22 bp, Artificial Sequence
  chemically synthesized
gagctgtttcacaagtagctta

SEQ ID NO: 1404324 - DNA, 22 bp, Artificial Sequence
  chemically synthesized
agcctaagtgagattaagctac

SEQ ID NO: 1404325 - DNA, 22 bp, Artificial Sequence
  chemically synthesized
tttcacaagtagcttaatctca

SEQ ID NO: 1404326 - DNA, 22 bp, Artificial Sequence
  chemically synthesized
cacaagtagcttaatctcactt

SEQ ID NO: 1404327 - DNA, 22 bp, Artificial Sequence
  chemically synthesized
gaagctgagcctaagtgagatt

SEQ ID NO: 1404328 - DNA, 22 bp, Artificial Sequence
  chemically synthesized
acaagtagcttaatctcactta

SEQ ID NO: 1404329 - DNA, 22 bp, Artificial Sequence
  chemically synthesized
tagatctagaagctgagcctaa

SEQ ID NO: 1404330 - DNA, 22 bp, Artificial Sequence
  chemically synthesized
atagatctagaagctgagccta

SEQ ID NO: 1404331 - DNA, 22 bp, Artificial Sequence
  chemically synthesized
aatctcacttaggctcagcttc

SEQ ID NO: 1404332 - DNA, 22 bp, Artificial Sequence
  chemically synthesized
atctcacttaggctcagcttct

SEQ ID NO: 1404333 - DNA, 22 bp, Artificial Sequence
  chemically synthesized
gtttatagatctagaagctgag

SEQ ID NO: 1404334 - DNA, 22 bp, Artificial Sequence
  chemically synthesized
acttaggctcagcttctagatc

SEQ ID NO: 1404335 - DNA, 22 bp, Artificial Sequence
  chemically synthesized
tgcctagtttatagatctagaa

SEQ ID NO: 1404336 - DNA, 22 bp, Artificial Sequence
  chemically synthesized
aggctcagcttctagatctata

SEQ ID NO: 1404337 - DNA, 22 bp, Artificial Sequence
  chemically synthesized
ttatgcctagtttatagatcta

SEQ ID NO: 1404338 - DNA, 22 bp, Artificial Sequence
  chemically synthesized
ggctcagcttctagatctataa

SEQ ID NO: 1404339 - DNA, 22 bp, Artificial Sequence
  chemically synthesized
attatgcctagtttatagatct

SEQ ID NO: 1404340 - DNA, 22 bp, Artificial Sequence
  chemically synthesized
tattatgcctagtttatagatc

SEQ ID NO: 1404341 - DNA, 22 bp, Artificial Sequence
  chemically synthesized
agcttctagatctataaactag

SEQ ID NO: 1404342 - DNA, 22 bp, Artificial Sequence
  chemically synthesized
ctagatctataaactaggcata

SEQ ID NO: 1404343 - DNA, 22 bp, Artificial Sequence
  chemically synthesized
tagatctataaactaggcataa

SEQ ID NO: 1404344 - DNA, 22 bp, Artificial Sequence
  chemically synthesized
gatctataaactaggcataata

SEQ ID NO: 1404345 - DNA, 22 bp, Artificial Sequence
  chemically synthesized
taaactaggcataataaaacat

SEQ ID NO: 1404346 - DNA, 22 bp, Artificial Sequence
  chemically synthesized
gaacaacccccgccaaaatgtt

SEQ ID NO: 1404347 - DNA, 22 bp, Artificial Sequence
  chemically synthesized
ggaacaacccccgccaaaatgt

SEQ ID NO: 1404348 - DNA, 22 bp, Artificial Sequence
  chemically synthesized
ggcataataaaacattttggcg

SEQ ID NO: 1404349 - DNA, 22 bp, Artificial Sequence
  chemically synthesized
tggaacaacccccgccaaaatg

SEQ ID NO: 1404350 - DNA, 22 bp, Artificial Sequence
  chemically synthesized
atctttggaacaacccccgcca

SEQ ID NO: 1404351 - DNA, 22 bp, Artificial Sequence
  chemically synthesized
gctaatctttggaacaaccccc

SEQ ID NO: 1404352 - DNA, 22 bp, Artificial Sequence
  chemically synthesized
agctaatctttggaacaacccc

SEQ ID NO: 1404353 - DNA, 22 bp, Artificial Sequence
  chemically synthesized
tagctaatctttggaacaaccc

SEQ ID NO: 1404354 - DNA, 22 bp, Artificial Sequence
  chemically synthesized
ttttagctaatctttggaacaa

SEQ ID NO: 1404355 - DNA, 22 bp, Artificial Sequence
  chemically synthesized
tggcgggggttgttccaaagat

SEQ ID NO: 1404356 - DNA, 22 bp, Artificial Sequence
  chemically synthesized
ggcgggggttgttccaaagatt

SEQ ID NO: 1404357 - DNA, 22 bp, Artificial Sequence
  chemically synthesized
gcgggggttgttccaaagatta

SEQ ID NO: 1404358 - DNA, 22 bp, Artificial Sequence
  chemically synthesized
atgcgttattttagctaatctt

SEQ ID NO: 1404359 - DNA, 22 bp, Artificial Sequence
  chemically synthesized
ttccaaagattagctaaaataa

SEQ ID NO: 1404360 - DNA, 22 bp, Artificial Sequence
  chemically synthesized
caaagattagctaaaataacgc

SEQ ID NO: 1404361 - DNA, 22 bp, Artificial Sequence
  chemically synthesized
ggtgcagttcatgcgttatttt

SEQ ID NO: 1404362 - DNA, 22 bp, Artificial Sequence
  chemically synthesized
acatgctaggtgcagttcatgc

SEQ ID NO: 1404363 - DNA, 22 bp, Artificial Sequence
  chemically synthesized
gctaaaataacgcatgaactgc

SEQ ID NO: 1404364 - DNA, 22 bp, Artificial Sequence
  chemically synthesized
aacatgctaggtgcagttcatg

SEQ ID NO: 1404365 - DNA, 22 bp, Artificial Sequence
  chemically synthesized
taacatgctaggtgcagttcat

SEQ ID NO: 1404366 - DNA, 22 bp, Artificial Sequence
  chemically synthesized
ttaacatgctaggtgcagttca

SEQ ID NO: 1404367 - DNA, 22 bp, Artificial Sequence
  chemically synthesized
aaataacgcatgaactgcacct

SEQ ID NO: 1404368 - DNA, 22 bp, Artificial Sequence
  chemically synthesized
tttttaacatgctaggtgcagt

SEQ ID NO: 1404369 - DNA, 22 bp, Artificial Sequence
  chemically synthesized
atttttaacatgctaggtgcag

SEQ ID NO: 1404370 - DNA, 22 bp, Artificial Sequence
  chemically synthesized
tttatttttaacatgctaggtg

SEQ ID NO: 1404371 - DNA, 22 bp, Artificial Sequence
  chemically synthesized
ctatttatttttaacatgctag

SEQ ID NO: 1404372 - DNA, 22 bp, Artificial Sequence
  chemically synthesized
actatttatttttaacatgcta

SEQ ID NO: 1404373 - DNA, 22 bp, Artificial Sequence
  chemically synthesized
atatttactatttatttttaac

SEQ ID NO: 1404374 - DNA, 22 bp, Artificial Sequence
  chemically synthesized
cacctagcatgttaaaaataaa

SEQ ID NO: 1404375 - DNA, 22 bp, Artificial Sequence
  chemically synthesized
gcatgttaaaaataaatagtaa

SEQ ID NO: 1404376 - DNA, 22 bp, Artificial Sequence
  chemically synthesized
gtacattaatatttactattta

SEQ ID NO: 1404377 - DNA, 22 bp, Artificial Sequence
  chemically synthesized
ctagtacattaatatttactat

SEQ ID NO: 1404378 - DNA, 22 bp, Artificial Sequence
  chemically synthesized
aaaataaatagtaaatattaat

SEQ ID NO: 1404379 - DNA, 22 bp, Artificial Sequence
  chemically synthesized
caaaacataattactagtacat

SEQ ID NO: 1404380 - DNA, 22 bp, Artificial Sequence
  chemically synthesized
acaaaacataattactagtaca

SEQ ID NO: 1404381 - DNA, 22 bp, Artificial Sequence
  chemically synthesized
gtttacaaaacataattactag

SEQ ID NO: 1404382 - DNA, 22 bp, Artificial Sequence
  chemically synthesized
agtttacaaaacataattacta

SEQ ID NO: 1404383 - DNA, 22 bp, Artificial Sequence
  chemically synthesized
atgtactagtaattatgttttg

SEQ ID NO: 1404384 - DNA, 22 bp, Artificial Sequence
  chemically synthesized
gtaattatgttttgtaaactaa

SEQ ID NO: 1404385 - DNA, 22 bp, Artificial Sequence
  chemically synthesized
gtgagataaaatttagtttaca

SEQ ID NO: 1404386 - DNA, 22 bp, Artificial Sequence
  chemically synthesized
agtgagataaaatttagtttac

SEQ ID NO: 1404387 - DNA, 22 bp, Artificial Sequence
  chemically synthesized
tagtgagataaaatttagttta

SEQ ID NO: 1404388 - DNA, 22 bp, Artificial Sequence
  chemically synthesized
ttagtgagataaaatttagttt

SEQ ID NO: 1404389 - DNA, 22 bp, Artificial Sequence
  chemically synthesized
ttttagtgagataaaatttagt

SEQ ID NO: 1404390 - DNA, 22 bp, Artificial Sequence
  chemically synthesized
cttttagtgagataaaatttag

SEQ ID NO: 1404391 - DNA, 22 bp, Artificial Sequence
  chemically synthesized
tgttttgtaaactaaattttat

SEQ ID NO: 1404392 - DNA, 22 bp, Artificial Sequence
  chemically synthesized
tcttttagtgagataaaattta

SEQ ID NO: 1404393 - DNA, 22 bp, Artificial Sequence
  chemically synthesized
tgtaaactaaattttatctcac

SEQ ID NO: 1404394 - DNA, 22 bp, Artificial Sequence
  chemically synthesized
gtaaactaaattttatctcact

SEQ ID NO: 1404395 - DNA, 22 bp, Artificial Sequence
  chemically synthesized
taaactaaattttatctcacta

SEQ ID NO: 1404396 - DNA, 22 bp, Artificial Sequence
  chemically synthesized
caatactttcttttagtgagat

SEQ ID NO: 1404397 - DNA, 22 bp, Artificial Sequence
  chemically synthesized
acaatactttcttttagtgaga

SEQ ID NO: 1404398 - DNA, 22 bp, Artificial Sequence
  chemically synthesized
tacaatactttcttttagtgag

SEQ ID NO: 1404399 - DNA, 22 bp, Artificial Sequence
  chemically synthesized
aattttatctcactaaaagaaa

SEQ ID NO: 1404400 - DNA, 22 bp, Artificial Sequence
  chemically synthesized
tatctcactaaaagaaagtatt

SEQ ID NO: 1404401 - DNA, 22 bp, Artificial Sequence
  chemically synthesized
atctcactaaaagaaagtattg

SEQ ID NO: 1404402 - DNA, 22 bp, Artificial Sequence
  chemically synthesized
tctcactaaaagaaagtattgt

SEQ ID NO: 1404403 - DNA, 22 bp, Artificial Sequence
  chemically synthesized
actaaaagaaagtattgtaaaa

SEQ ID NO: 1404404 - DNA, 22 bp, Artificial Sequence
  chemically synthesized
aaagaaagtattgtaaaattta

SEQ ID NO: 1404405 - DNA, 22 bp, Artificial Sequence
  chemically synthesized
tagtggatgaagaacaacataa

SEQ ID NO: 1404406 - DNA, 22 bp, Artificial Sequence
  chemically synthesized
tatagtggatgaagaacaacat

SEQ ID NO: 1404407 - DNA, 22 bp, Artificial Sequence
  chemically synthesized
ctatagtggatgaagaacaaca

SEQ ID NO: 1404408 - DNA, 22 bp, Artificial Sequence
  chemically synthesized
tctatagtggatgaagaacaac

SEQ ID NO: 1404409 - DNA, 22 bp, Artificial Sequence
  chemically synthesized
taaaatttatgttgttcttcat

SEQ ID NO: 1404410 - DNA, 22 bp, Artificial Sequence
  chemically synthesized
attttctatagtggatgaagaa

SEQ ID NO: 1404411 - DNA, 22 bp, Artificial Sequence
  chemically synthesized
cattttctatagtggatgaaga

SEQ ID NO: 1404412 - DNA, 22 bp, Artificial Sequence
  chemically synthesized
tcattttctatagtggatgaag

SEQ ID NO: 1404413 - DNA, 22 bp, Artificial Sequence
  chemically synthesized
atgttgttcttcatccactata

SEQ ID NO: 1404414 - DNA, 22 bp, Artificial Sequence
  chemically synthesized
tgttgttcttcatccactatag

SEQ ID NO: 1404415 - DNA, 22 bp, Artificial Sequence
  chemically synthesized
aaaaagttttcattttctatag

SEQ ID NO: 1404416 - DNA, 22 bp, Artificial Sequence
  chemically synthesized
ttcttcatccactatagaaaat

SEQ ID NO: 1404417 - DNA, 22 bp, Artificial Sequence
  chemically synthesized
ttcatccactatagaaaatgaa

SEQ ID NO: 1404418 - DNA, 22 bp, Artificial Sequence
  chemically synthesized
attcaaaaagttttcattttct

SEQ ID NO: 1404419 - DNA, 22 bp, Artificial Sequence
  chemically synthesized
catccactatagaaaatgaaaa

SEQ ID NO: 1404420 - DNA, 22 bp, Artificial Sequence
  chemically synthesized
taattcaaaaagttttcatttt

SEQ ID NO: 1404421 - DNA, 22 bp, Artificial Sequence
  chemically synthesized
atccactatagaaaatgaaaac

SEQ ID NO: 1404422 - DNA, 22 bp, Artificial Sequence
  chemically synthesized
gttctaattcaaaaagttttca

SEQ ID NO: 1404423 - DNA, 22 bp, Artificial Sequence
  chemically synthesized
ggttctaattcaaaaagttttc

SEQ ID NO: 1404424 - DNA, 22 bp, Artificial Sequence
  chemically synthesized
tagaaaatgaaaactttttgaa

SEQ ID NO: 1404425 - DNA, 22 bp, Artificial Sequence
  chemically synthesized
caaatttggttctaattcaaaa

SEQ ID NO: 1404426 - DNA, 22 bp, Artificial Sequence
  chemically synthesized
ccattccaaatttggttctaat

SEQ ID NO: 1404427 - DNA, 22 bp, Artificial Sequence
  chemically synthesized
tttgaattagaaccaaatttgg

SEQ ID NO: 1404428 - DNA, 22 bp, Artificial Sequence
  chemically synthesized
gatgttcccattccaaatttgg

SEQ ID NO: 1404429 - DNA, 22 bp, Artificial Sequence
  chemically synthesized
ttgaattagaaccaaatttgga

SEQ ID NO: 1404430 - DNA, 22 bp, Artificial Sequence
  chemically synthesized
ggatgttcccattccaaatttg

SEQ ID NO: 1404431 - DNA, 22 bp, Artificial Sequence
  chemically synthesized
tgaattagaaccaaatttggaa

SEQ ID NO: 1404432 - DNA, 22 bp, Artificial Sequence
  chemically synthesized
gaattagaaccaaatttggaat

SEQ ID NO: 1404433 - DNA, 22 bp, Artificial Sequence
  chemically synthesized
aattagaaccaaatttggaatg

SEQ ID NO: 1404434 - DNA, 22 bp, Artificial Sequence
  chemically synthesized
cttggatgttcccattccaaat

SEQ ID NO: 1404435 - DNA, 22 bp, Artificial Sequence
  chemically synthesized
ttacttggatgttcccattcca

SEQ ID NO: 1404436 - DNA, 22 bp, Artificial Sequence
  chemically synthesized
attacttggatgttcccattcc

SEQ ID NO: 1404437 - DNA, 22 bp, Artificial Sequence
  chemically synthesized
gaaccaaatttggaatgggaac

SEQ ID NO: 1404438 - DNA, 22 bp, Artificial Sequence
  chemically synthesized
ttattacttggatgttcccatt

SEQ ID NO: 1404439 - DNA, 22 bp, Artificial Sequence
  chemically synthesized
ttcttattacttggatgttccc

SEQ ID NO: 1404440 - DNA, 22 bp, Artificial Sequence
  chemically synthesized
attcttattacttggatgttcc

SEQ ID NO: 1404441 - DNA, 22 bp, Artificial Sequence
  chemically synthesized
ggaatgggaacatccaagtaat

SEQ ID NO: 1404442 - DNA, 22 bp, Artificial Sequence
  chemically synthesized
acatttattcttattacttgga

SEQ ID NO: 1404443 - DNA, 22 bp, Artificial Sequence
  chemically synthesized
gaatgggaacatccaagtaata

SEQ ID NO: 1404444 - DNA, 22 bp, Artificial Sequence
  chemically synthesized
cacatttattcttattacttgg

SEQ ID NO: 1404445 - DNA, 22 bp, Artificial Sequence
  chemically synthesized
tcacatttattcttattacttg

SEQ ID NO: 1404446 - DNA, 22 bp, Artificial Sequence
  chemically synthesized
ttcacatttattcttattactt

SEQ ID NO: 1404447 - DNA, 22 bp, Artificial Sequence
  chemically synthesized
ttttcacatttattcttattac

SEQ ID NO: 1404448 - DNA, 22 bp, Artificial Sequence
  chemically synthesized
cttttcacatttattcttatta

SEQ ID NO: 1404449 - DNA, 22 bp, Artificial Sequence
  chemically synthesized
agtttcttttcacatttattct

SEQ ID NO: 1404450 - DNA, 22 bp, Artificial Sequence
  chemically synthesized
tattcagtttcttttcacattt

SEQ ID NO: 1404451 - DNA, 22 bp, Artificial Sequence
  chemically synthesized
ttatattcagtttcttttcaca

SEQ ID NO: 1404452 - DNA, 22 bp, Artificial Sequence
  chemically synthesized
ttattatattcagtttcttttc

SEQ ID NO: 1404453 - DNA, 22 bp, Artificial Sequence
  chemically synthesized
attattatattcagtttctttt

SEQ ID NO: 1404454 - DNA, 22 bp, Artificial Sequence
  chemically synthesized
tattattatattcagtttcttt

SEQ ID NO: 1404455 - DNA, 22 bp, Artificial Sequence
  chemically synthesized
ataactttattattatattcag

SEQ ID NO: 1404456 - DNA, 22 bp, Artificial Sequence
  chemically synthesized
cataactttattattatattca

SEQ ID NO: 1404457 - DNA, 22 bp, Artificial Sequence
  chemically synthesized
tcataactttattattatattc

SEQ ID NO: 1404458 - DNA, 22 bp, Artificial Sequence
  chemically synthesized
tttcataactttattattatat

SEQ ID NO: 1404459 - DNA, 22 bp, Artificial Sequence
  chemically synthesized
ctctttcataactttattatta

SEQ ID NO: 1404460 - DNA, 22 bp, Artificial Sequence
  chemically synthesized
cctctttcataactttattatt

SEQ ID NO: 1404461 - DNA, 22 bp, Artificial Sequence
  chemically synthesized
tcctctttcataactttattat

SEQ ID NO: 1404462 - DNA, 22 bp, Artificial Sequence
  chemically synthesized
ttcctctttcataactttatta

SEQ ID NO: 1404463 - DNA, 22 bp, Artificial Sequence
  chemically synthesized
tttttcctctttcataacttta

SEQ ID NO: 1404464 - DNA, 22 bp, Artificial Sequence
  chemically synthesized
atttttcctctttcataacttt

SEQ ID NO: 1404465 - DNA, 22 bp, Artificial Sequence
  chemically synthesized
aatataataataaagttatgaa

SEQ ID NO: 1404466 - DNA, 22 bp, Artificial Sequence
  chemically synthesized
tatttttcctctttcataactt

SEQ ID NO: 1404467 - DNA, 22 bp, Artificial Sequence
  chemically synthesized
ggcatcagattttatttttcct

SEQ ID NO: 1404468 - DNA, 22 bp, Artificial Sequence
  chemically synthesized
cggcatcagattttatttttcc

SEQ ID NO: 1404469 - DNA, 22 bp, Artificial Sequence
  chemically synthesized
tcggcatcagattttatttttc

SEQ ID NO: 1404470 - DNA, 22 bp, Artificial Sequence
  chemically synthesized
ttcggcatcagattttattttt

SEQ ID NO: 1404471 - DNA, 22 bp, Artificial Sequence
  chemically synthesized
ttttcggcatcagattttattt

SEQ ID NO: 1404472 - DNA, 22 bp, Artificial Sequence
  chemically synthesized
tgaaagaggaaaaataaaatct

SEQ ID NO: 1404473 - DNA, 22 bp, Artificial Sequence
  chemically synthesized
tatgttcttttcggcatcagat

SEQ ID NO: 1404474 - DNA, 22 bp, Artificial Sequence
  chemically synthesized
atgccgaaaagaacatataggt

SEQ ID NO: 1404475 - DNA, 22 bp, Artificial Sequence
  chemically synthesized
aaaaaacaaaggaaaacaaaac

SEQ ID NO: 1404476 - DNA, 22 bp, Artificial Sequence
  chemically synthesized
tttttgttttgttttgttttcc

SEQ ID NO: 1404477 - DNA, 22 bp, Artificial Sequence
  chemically synthesized
ttttgttttgttttgttttcct

SEQ ID NO: 1404478 - DNA, 22 bp, Artificial Sequence
  chemically synthesized
tttgttttgttttgttttcctt

SEQ ID NO: 1404479 - DNA, 22 bp, Artificial Sequence
  chemically synthesized
tctcaaaaaacaaaggaaaaca

SEQ ID NO: 1404480 - DNA, 22 bp, Artificial Sequence
  chemically synthesized
ttgttttgttttgttttccttt

SEQ ID NO: 1404481 - DNA, 22 bp, Artificial Sequence
  chemically synthesized
tgttttgttttgttttcctttg

SEQ ID NO: 1404482 - DNA, 22 bp, Artificial Sequence
  chemically synthesized
tgtctcaaaaaacaaaggaaaa

SEQ ID NO: 1404483 - DNA, 22 bp, Artificial Sequence
  chemically synthesized
gttttgttttgttttcctttgt

SEQ ID NO: 1404484 - DNA, 22 bp, Artificial Sequence
  chemically synthesized
ttttgttttgttttcctttgtt

SEQ ID NO: 1404485 - DNA, 22 bp, Artificial Sequence
  chemically synthesized
tgttttgttttcctttgttttt

SEQ ID NO: 1404486 - DNA, 22 bp, Artificial Sequence
  chemically synthesized
gttttgttttcctttgtttttt

SEQ ID NO: 1404487 - DNA, 22 bp, Artificial Sequence
  chemically synthesized
ttttgttttcctttgttttttg

SEQ ID NO: 1404488 - DNA, 22 bp, Artificial Sequence
  chemically synthesized
tgttttcctttgttttttgaga

SEQ ID NO: 1404489 - DNA, 22 bp, Artificial Sequence
  chemically synthesized
gttttcctttgttttttgagac

SEQ ID NO: 1404490 - DNA, 22 bp, Artificial Sequence
  chemically synthesized
ttttcctttgttttttgagaca

SEQ ID NO: 1404491 - DNA, 22 bp, Artificial Sequence
  chemically synthesized
tcctttgttttttgagacagaa

SEQ ID NO: 1404492 - DNA, 22 bp, Artificial Sequence
  chemically synthesized
cctttgttttttgagacagaat

SEQ ID NO: 1404493 - DNA, 22 bp, Artificial Sequence
  chemically synthesized
ctttgttttttgagacagaatc

SEQ ID NO: 1404494 - DNA, 22 bp, Artificial Sequence
  chemically synthesized
ggtgacagagtgagattctgtc

SEQ ID NO: 1404495 - DNA, 22 bp, Artificial Sequence
  chemically synthesized
tgttttttgagacagaatctca

SEQ ID NO: 1404496 - DNA, 22 bp, Artificial Sequence
  chemically synthesized
gttttttgagacagaatctcac

SEQ ID NO: 1404497 - DNA, 22 bp, Artificial Sequence
  chemically synthesized
ttttttgagacagaatctcact

SEQ ID NO: 1404498 - DNA, 22 bp, Artificial Sequence
  chemically synthesized
tttgagacagaatctcactctg

SEQ ID NO: 1404499 - DNA, 22 bp, Artificial Sequence
  chemically synthesized
caacctgggtgacagagtgaga

SEQ ID NO: 1404500 - DNA, 22 bp, Artificial Sequence
  chemically synthesized
ttgagacagaatctcactctgt

SEQ ID NO: 1404501 - DNA, 22 bp, Artificial Sequence
  chemically synthesized
tgagacagaatctcactctgtc

SEQ ID NO: 1404502 - DNA, 22 bp, Artificial Sequence
  chemically synthesized
gagacagaatctcactctgtca

SEQ ID NO: 1404503 - DNA, 22 bp, Artificial Sequence
  chemically synthesized
agacagaatctcactctgtcac

SEQ ID NO: 1404504 - DNA, 22 bp, Artificial Sequence
  chemically synthesized
actctgtcacccaggttggagt

SEQ ID NO: 1404505 - DNA, 22 bp, Artificial Sequence
  chemically synthesized
tgtcacccaggttggagtgcac

SEQ ID NO: 1404506 - DNA, 22 bp, Artificial Sequence
  chemically synthesized
tcacccaggttggagtgcactg

SEQ ID NO: 1404507 - DNA, 22 bp, Artificial Sequence
  chemically synthesized
caatgagtcaagatcgtgccag

SEQ ID NO: 1404508 - DNA, 22 bp, Artificial Sequence
  chemically synthesized
gagtgcactggcacgatcttga

SEQ ID NO: 1404509 - DNA, 22 bp, Artificial Sequence
  chemically synthesized
aggttgcaatgagtcaagatcg

SEQ ID NO: 1404510 - DNA, 22 bp, Artificial Sequence
  chemically synthesized
gcacgatcttgactcattgcaa

SEQ ID NO: 1404511 - DNA, 22 bp, Artificial Sequence
  chemically synthesized
aacccaggaggctgaggttgca

SEQ ID NO: 1404512 - DNA, 22 bp, Artificial Sequence
  chemically synthesized
gaacccaggaggctgaggttgc

SEQ ID NO: 1404513 - DNA, 22 bp, Artificial Sequence
  chemically synthesized
gactcattgcaacctcagcctc

SEQ ID NO: 1404514 - DNA, 22 bp, Artificial Sequence
  chemically synthesized
actcattgcaacctcagcctcc

SEQ ID NO: 1404515 - DNA, 22 bp, Artificial Sequence
  chemically synthesized
attgcaacctcagcctcctggg

SEQ ID NO: 1404516 - DNA, 22 bp, Artificial Sequence
  chemically synthesized
caacctcagcctcctgggttca

SEQ ID NO: 1404517 - DNA, 22 bp, Artificial Sequence
  chemically synthesized
aggcagaagaatcgcttgaacc

SEQ ID NO: 1404518 - DNA, 22 bp, Artificial Sequence
  chemically synthesized
agcctcctgggttcaagcgatt

SEQ ID NO: 1404519 - DNA, 22 bp, Artificial Sequence
  chemically synthesized
ctgggttcaagcgattcttctg

SEQ ID NO: 1404520 - DNA, 22 bp, Artificial Sequence
  chemically synthesized
gggaggctgaggcagaagaatc

SEQ ID NO: 1404521 - DNA, 22 bp, Artificial Sequence
  chemically synthesized
ggttcaagcgattcttctgcct

SEQ ID NO: 1404522 - DNA, 22 bp, Artificial Sequence
  chemically synthesized
ctcgggaggctgaggcagaaga

SEQ ID NO: 1404523 - DNA, 22 bp, Artificial Sequence
  chemically synthesized
aagcgattcttctgcctcagcc

SEQ ID NO: 1404524 - DNA, 22 bp, Artificial Sequence
  chemically synthesized
tagtcccagctactcgggaggc

SEQ ID NO: 1404525 - DNA, 22 bp, Artificial Sequence
  chemically synthesized
ttctgcctcagcctcccgagta

SEQ ID NO: 1404526 - DNA, 22 bp, Artificial Sequence
  chemically synthesized
ctgcctcagcctcccgagtagc

SEQ ID NO: 1404527 - DNA, 22 bp, Artificial Sequence
  chemically synthesized
tgcctcagcctcccgagtagct

SEQ ID NO: 1404528 - DNA, 22 bp, Artificial Sequence
  chemically synthesized
cctcagcctcccgagtagctgg

SEQ ID NO: 1404529 - DNA, 22 bp, Artificial Sequence
  chemically synthesized
acgtgcctgtagtcccagctac

SEQ ID NO: 1404530 - DNA, 22 bp, Artificial Sequence
  chemically synthesized
agcctcccgagtagctgggact

SEQ ID NO: 1404531 - DNA, 22 bp, Artificial Sequence
  chemically synthesized
ccgagtagctgggactacaggc

SEQ ID NO: 1404532 - DNA, 22 bp, Artificial Sequence
  chemically synthesized
ggtgggctcacgtgcctgtagt

SEQ ID NO: 1404533 - DNA, 22 bp, Artificial Sequence
  chemically synthesized
ggactacaggcacgtgagccca

SEQ ID NO: 1404534 - DNA, 22 bp, Artificial Sequence
  chemically synthesized
aaaacacaaaaattaggtgggc

SEQ ID NO: 1404535 - DNA, 22 bp, Artificial Sequence
  chemically synthesized
caggcacgtgagcccacctaat

SEQ ID NO: 1404536 - DNA, 22 bp, Artificial Sequence
  chemically synthesized
ctaaaaacacaaaaattaggtg

SEQ ID NO: 1404537 - DNA, 22 bp, Artificial Sequence
  chemically synthesized
tactaaaaacacaaaaattagg

SEQ ID NO: 1404538 - DNA, 22 bp, Artificial Sequence
  chemically synthesized
atttttgtgtttttagtagaga

SEQ ID NO: 1404539 - DNA, 22 bp, Artificial Sequence
  chemically synthesized
ttgtgtttttagtagagatggg

SEQ ID NO: 1404540 - DNA, 22 bp, Artificial Sequence
  chemically synthesized
tgtgtttttagtagagatgggg

SEQ ID NO: 1404541 - DNA, 22 bp, Artificial Sequence
  chemically synthesized
gtgtttttagtagagatggggt

SEQ ID NO: 1404542 - DNA, 22 bp, Artificial Sequence
  chemically synthesized
tgtttttagtagagatggggtt

SEQ ID NO: 1404543 - DNA, 22 bp, Artificial Sequence
  chemically synthesized
gccaatatggtgaaaccccatc

SEQ ID NO: 1404544 - DNA, 22 bp, Artificial Sequence
  chemically synthesized
ttagtagagatggggtttcacc

SEQ ID NO: 1404545 - DNA, 22 bp, Artificial Sequence
  chemically synthesized
tagtagagatggggtttcacca

SEQ ID NO: 1404546 - DNA, 22 bp, Artificial Sequence
  chemically synthesized
agtagagatggggtttcaccat

SEQ ID NO: 1404547 - DNA, 22 bp, Artificial Sequence
  chemically synthesized
gtagagatggggtttcaccata

SEQ ID NO: 1404548 - DNA, 22 bp, Artificial Sequence
  chemically synthesized
gagaccagcctggccaatatgg

SEQ ID NO: 1404549 - DNA, 22 bp, Artificial Sequence
  chemically synthesized
caccatattggccaggctggtc

SEQ ID NO: 1404550 - DNA, 22 bp, Artificial Sequence
  chemically synthesized
accatattggccaggctggtct

SEQ ID NO: 1404551 - DNA, 22 bp, Artificial Sequence
  chemically synthesized
gccaggctggtctcgaactcct

SEQ ID NO: 1404552 - DNA, 22 bp, Artificial Sequence
  chemically synthesized
gtctcgaactcctgacctcatg

SEQ ID NO: 1404553 - DNA, 22 bp, Artificial Sequence
  chemically synthesized
gaactcctgacctcatgataca

SEQ ID NO: 1404554 - DNA, 22 bp, Artificial Sequence
  chemically synthesized
ggaggtcgaggtgggtgtatca

SEQ ID NO: 1404555 - DNA, 22 bp, Artificial Sequence
  chemically synthesized
gggaggtcgaggtgggtgtatc

SEQ ID NO: 1404556 - DNA, 22 bp, Artificial Sequence
  chemically synthesized
tgggaggtcgaggtgggtgtat

SEQ ID NO: 1404557 - DNA, 22 bp, Artificial Sequence
  chemically synthesized
ctgacctcatgatacacccacc

SEQ ID NO: 1404558 - DNA, 22 bp, Artificial Sequence
  chemically synthesized
acctcatgatacacccacctcg

SEQ ID NO: 1404559 - DNA, 22 bp, Artificial Sequence
  chemically synthesized
atgatacacccacctcgacctc

SEQ ID NO: 1404560 - DNA, 22 bp, Artificial Sequence
  chemically synthesized
taatcccagcattttgggaggt

SEQ ID NO: 1404561 - DNA, 22 bp, Artificial Sequence
  chemically synthesized
atgcctgtaatcccagcatttt

SEQ ID NO: 1404562 - DNA, 22 bp, Artificial Sequence
  chemically synthesized
gacctcccaaaatgctgggatt

SEQ ID NO: 1404563 - DNA, 22 bp, Artificial Sequence
  chemically synthesized
ccaaaatgctgggattacaggc

SEQ ID NO: 1404564 - DNA, 22 bp, Artificial Sequence
  chemically synthesized
ggattacaggcatgagccacca

SEQ ID NO: 1404565 - DNA, 22 bp, Artificial Sequence
  chemically synthesized
tatgggccgggcgtggtggctc

SEQ ID NO: 1404566 - DNA, 22 bp, Artificial Sequence
  chemically synthesized
caggcatgagccaccacgcccg

SEQ ID NO: 1404567 - DNA, 22 bp, Artificial Sequence
  chemically synthesized
aacctgtatgggccgggcgtgg

SEQ ID NO: 1404568 - DNA, 22 bp, Artificial Sequence
  chemically synthesized
aaacctgtatgggccgggcgtg

SEQ ID NO: 1404569 - DNA, 22 bp, Artificial Sequence
  chemically synthesized
tatagcatggccatgcaatatt

SEQ ID NO: 1404570 - DNA, 22 bp, Artificial Sequence
  chemically synthesized
ttgtatagcatggccatgcaat

SEQ ID NO: 1404571 - DNA, 22 bp, Artificial Sequence
  chemically synthesized
aaatattgcatggccatgctat

SEQ ID NO: 1404572 - DNA, 22 bp, Artificial Sequence
  chemically synthesized
acaaactgttgtatagcatggc

SEQ ID NO: 1404573 - DNA, 22 bp, Artificial Sequence
  chemically synthesized
aatattgcatggccatgctata

SEQ ID NO: 1404574 - DNA, 22 bp, Artificial Sequence
  chemically synthesized
agctaacaaactgttgtatagc

SEQ ID NO: 1404575 - DNA, 22 bp, Artificial Sequence
  chemically synthesized
cagctaacaaactgttgtatag

SEQ ID NO: 1404576 - DNA, 22 bp, Artificial Sequence
  chemically synthesized
catggccatgctatacaacagt

SEQ ID NO: 1404577 - DNA, 22 bp, Artificial Sequence
  chemically synthesized
tacaacagtttgttagctgaag

SEQ ID NO: 1404578 - DNA, 22 bp, Artificial Sequence
  chemically synthesized
tgaacaaaaatatcttcagcta

SEQ ID NO: 1404579 - DNA, 22 bp, Artificial Sequence
  chemically synthesized
gtgaacaaaaatatcttcagct

SEQ ID NO: 1404580 - DNA, 22 bp, Artificial Sequence
  chemically synthesized
tgtgaacaaaaatatcttcagc

SEQ ID NO: 1404581 - DNA, 22 bp, Artificial Sequence
  chemically synthesized
attttgtgaacaaaaatatctt

SEQ ID NO: 1404582 - DNA, 22 bp, Artificial Sequence
  chemically synthesized
gttagctgaagatatttttgtt

SEQ ID NO: 1404583 - DNA, 22 bp, Artificial Sequence
  chemically synthesized
attgattttgtgaacaaaaata

SEQ ID NO: 1404584 - DNA, 22 bp, Artificial Sequence
  chemically synthesized
ttagctgaagatatttttgttc

SEQ ID NO: 1404585 - DNA, 22 bp, Artificial Sequence
  chemically synthesized
gctgaagatatttttgttcaca

SEQ ID NO: 1404586 - DNA, 22 bp, Artificial Sequence
  chemically synthesized
atctcattgattttgtgaacaa

SEQ ID NO: 1404587 - DNA, 22 bp, Artificial Sequence
  chemically synthesized
aagatatttttgttcacaaaat

SEQ ID NO: 1404588 - DNA, 22 bp, Artificial Sequence
  chemically synthesized
ttgttcacaaaatcaatgagat

SEQ ID NO: 1404589 - DNA, 22 bp, Artificial Sequence
  chemically synthesized
tgttcacaaaatcaatgagatt

SEQ ID NO: 1404590 - DNA, 22 bp, Artificial Sequence
  chemically synthesized
gttcacaaaatcaatgagatta

SEQ ID NO: 1404591 - DNA, 22 bp, Artificial Sequence
  chemically synthesized
ttcacaaaatcaatgagattaa

SEQ ID NO: 1404592 - DNA, 22 bp, Artificial Sequence
  chemically synthesized
acaaaatcaatgagattaatca

SEQ ID NO: 1404593 - DNA, 22 bp, Artificial Sequence
  chemically synthesized
atagcaagtatagagtgatgcg

SEQ ID NO: 1404594 - DNA, 22 bp, Artificial Sequence
  chemically synthesized
aatagcaagtatagagtgatgc

SEQ ID NO: 1404595 - DNA, 22 bp, Artificial Sequence
  chemically synthesized
taatagcaagtatagagtgatg

SEQ ID NO: 1404596 - DNA, 22 bp, Artificial Sequence
  chemically synthesized
atcacgcatcactctatacttg

SEQ ID NO: 1404597 - DNA, 22 bp, Artificial Sequence
  chemically synthesized
tatacttgctattaaaattact

SEQ ID NO: 1404598 - DNA, 22 bp, Artificial Sequence
  chemically synthesized
tacttgctattaaaattactat

SEQ ID NO: 1404599 - DNA, 22 bp, Artificial Sequence
  chemically synthesized
gctattaaaattactatgtcac

SEQ ID NO: 1404600 - DNA, 22 bp, Artificial Sequence
  chemically synthesized
ctattaaaattactatgtcacg

SEQ ID NO: 1404601 - DNA, 22 bp, Artificial Sequence
  chemically synthesized
ttaaaattactatgtcacgcat

SEQ ID NO: 1404602 - DNA, 22 bp, Artificial Sequence
  chemically synthesized
gaaggccacaaaatgcgtgaca

SEQ ID NO: 1404603 - DNA, 22 bp, Artificial Sequence
  chemically synthesized
ggaaggccacaaaatgcgtgac

SEQ ID NO: 1404604 - DNA, 22 bp, Artificial Sequence
  chemically synthesized
tggaaggccacaaaatgcgtga

SEQ ID NO: 1404605 - DNA, 22 bp, Artificial Sequence
  chemically synthesized
aaattactatgtcacgcatttt

SEQ ID NO: 1404606 - DNA, 22 bp, Artificial Sequence
  chemically synthesized
ttggaaggccacaaaatgcgtg

SEQ ID NO: 1404607 - DNA, 22 bp, Artificial Sequence
  chemically synthesized
ttttggaaggccacaaaatgcg

SEQ ID NO: 1404608 - DNA, 22 bp, Artificial Sequence
  chemically synthesized
ctatgtcacgcattttgtggcc

SEQ ID NO: 1404609 - DNA, 22 bp, Artificial Sequence
  chemically synthesized
tctcttttggaaggccacaaaa

SEQ ID NO: 1404610 - DNA, 22 bp, Artificial Sequence
  chemically synthesized
gtctcttttggaaggccacaaa

SEQ ID NO: 1404611 - DNA, 22 bp, Artificial Sequence
  chemically synthesized
tgtcacgcattttgtggccttc

SEQ ID NO: 1404612 - DNA, 22 bp, Artificial Sequence
  chemically synthesized
cttgtctcttttggaaggccac

SEQ ID NO: 1404613 - DNA, 22 bp, Artificial Sequence
  chemically synthesized
aaactccttgtctcttttggaa

SEQ ID NO: 1404614 - DNA, 22 bp, Artificial Sequence
  chemically synthesized
tgtggccttccaaaagagacaa

SEQ ID NO: 1404615 - DNA, 22 bp, Artificial Sequence
  chemically synthesized
gtggccttccaaaagagacaag

SEQ ID NO: 1404616 - DNA, 22 bp, Artificial Sequence
  chemically synthesized
tgactcaaactccttgtctctt

SEQ ID NO: 1404617 - DNA, 22 bp, Artificial Sequence
  chemically synthesized
tggccttccaaaagagacaagg

SEQ ID NO: 1404618 - DNA, 22 bp, Artificial Sequence
  chemically synthesized
atactgtgactcaaactccttg

SEQ ID NO: 1404619 - DNA, 22 bp, Artificial Sequence
  chemically synthesized
ccaaaagagacaaggagtttga

SEQ ID NO: 1404620 - DNA, 22 bp, Artificial Sequence
  chemically synthesized
caaaagagacaaggagtttgag

SEQ ID NO: 1404621 - DNA, 22 bp, Artificial Sequence
  chemically synthesized
tctaatactgtgactcaaactc

SEQ ID NO: 1404622 - DNA, 22 bp, Artificial Sequence
  chemically synthesized
gtctaatactgtgactcaaact

SEQ ID NO: 1404623 - DNA, 22 bp, Artificial Sequence
  chemically synthesized
gtcttgtctaatactgtgactc

SEQ ID NO: 1404624 - DNA, 22 bp, Artificial Sequence
  chemically synthesized
agtcttgtctaatactgtgact

SEQ ID NO: 1404625 - DNA, 22 bp, Artificial Sequence
  chemically synthesized
tagtcttgtctaatactgtgac

SEQ ID NO: 1404626 - DNA, 22 bp, Artificial Sequence
  chemically synthesized
gagtcacagtattagacaagac

SEQ ID NO: 1404627 - DNA, 22 bp, Artificial Sequence
  chemically synthesized
agtcacagtattagacaagact

SEQ ID NO: 1404628 - DNA, 22 bp, Artificial Sequence
  chemically synthesized
gtaaaccatgtagggtctttag

SEQ ID NO: 1404629 - DNA, 22 bp, Artificial Sequence
  chemically synthesized
tagtaaaccatgtagggtcttt

SEQ ID NO: 1404630 - DNA, 22 bp, Artificial Sequence
  chemically synthesized
ctagtaaaccatgtagggtctt

SEQ ID NO: 1404631 - DNA, 22 bp, Artificial Sequence
  chemically synthesized
tctagtaaaccatgtagggtct

SEQ ID NO: 1404632 - DNA, 22 bp, Artificial Sequence
  chemically synthesized
gacaagactaaagaccctacat

SEQ ID NO: 1404633 - DNA, 22 bp, Artificial Sequence
  chemically synthesized
ttctagtaaaccatgtagggtc

SEQ ID NO: 1404634 - DNA, 22 bp, Artificial Sequence
  chemically synthesized
tttctagtaaaccatgtagggt

SEQ ID NO: 1404635 - DNA, 22 bp, Artificial Sequence
  chemically synthesized
ttttctagtaaaccatgtaggg

SEQ ID NO: 1404636 - DNA, 22 bp, Artificial Sequence
  chemically synthesized
aagaccctacatggtttactag

SEQ ID NO: 1404637 - DNA, 22 bp, Artificial Sequence
  chemically synthesized
aagtaaagggtttttttctagt

SEQ ID NO: 1404638 - DNA, 22 bp, Artificial Sequence
  chemically synthesized
catggtttactagaaaaaaacc

SEQ ID NO: 1404639 - DNA, 22 bp, Artificial Sequence
  chemically synthesized
acactgaagtaaagggtttttt

SEQ ID NO: 1404640 - DNA, 22 bp, Artificial Sequence
  chemically synthesized
ctgacactgaagtaaagggttt

SEQ ID NO: 1404641 - DNA, 22 bp, Artificial Sequence
  chemically synthesized
actagaaaaaaaccctttactt

SEQ ID NO: 1404642 - DNA, 22 bp, Artificial Sequence
  chemically synthesized
ctagaaaaaaaccctttacttc

SEQ ID NO: 1404643 - DNA, 22 bp, Artificial Sequence
  chemically synthesized
gaaaaaaaccctttacttcagt

SEQ ID NO: 1404644 - DNA, 22 bp, Artificial Sequence
  chemically synthesized
tacttcagtgtcaggagacttt

SEQ ID NO: 1404645 - DNA, 22 bp, Artificial Sequence
  chemically synthesized
acttcagtgtcaggagactttt

SEQ ID NO: 1404646 - DNA, 22 bp, Artificial Sequence
  chemically synthesized
cttcagtgtcaggagactttta

SEQ ID NO: 1404647 - DNA, 22 bp, Artificial Sequence
  chemically synthesized
cagtgtcaggagacttttatta

SEQ ID NO: 1404648 - DNA, 22 bp, Artificial Sequence
  chemically synthesized
agtgtcaggagacttttattac

SEQ ID NO: 1404649 - DNA, 22 bp, Artificial Sequence
  chemically synthesized
gtagtaaggccagatacgtaat

SEQ ID NO: 1404650 - DNA, 22 bp, Artificial Sequence
  chemically synthesized
cagttagtagtaaggccagata

SEQ ID NO: 1404651 - DNA, 22 bp, Artificial Sequence
  chemically synthesized
ccagttagtagtaaggccagat

SEQ ID NO: 1404652 - DNA, 22 bp, Artificial Sequence
  chemically synthesized
ttccagttagtagtaaggccag

SEQ ID NO: 1404653 - DNA, 22 bp, Artificial Sequence
  chemically synthesized
ttattacgtatctggccttact

SEQ ID NO: 1404654 - DNA, 22 bp, Artificial Sequence
  chemically synthesized
cttccagttagtagtaaggcca

SEQ ID NO: 1404655 - DNA, 22 bp, Artificial Sequence
  chemically synthesized
tattacgtatctggccttacta

SEQ ID NO: 1404656 - DNA, 22 bp, Artificial Sequence
  chemically synthesized
attacgtatctggccttactac

SEQ ID NO: 1404657 - DNA, 22 bp, Artificial Sequence
  chemically synthesized
ttacgtatctggccttactact

SEQ ID NO: 1404658 - DNA, 22 bp, Artificial Sequence
  chemically synthesized
agtttcttccagttagtagtaa

SEQ ID NO: 1404659 - DNA, 22 bp, Artificial Sequence
  chemically synthesized
cgtatctggccttactactaac

SEQ ID NO: 1404660 - DNA, 22 bp, Artificial Sequence
  chemically synthesized
aagtttcttccagttagtagta

SEQ ID NO: 1404661 - DNA, 22 bp, Artificial Sequence
  chemically synthesized
taagtttcttccagttagtagt

SEQ ID NO: 1404662 - DNA, 22 bp, Artificial Sequence
  chemically synthesized
ttaagtttcttccagttagtag

SEQ ID NO: 1404663 - DNA, 22 bp, Artificial Sequence
  chemically synthesized
ttttaagtttcttccagttagt

SEQ ID NO: 1404664 - DNA, 22 bp, Artificial Sequence
  chemically synthesized
cttttaagtttcttccagttag

SEQ ID NO: 1404665 - DNA, 22 bp, Artificial Sequence
  chemically synthesized
gccttactactaactggaagaa

SEQ ID NO: 1404666 - DNA, 22 bp, Artificial Sequence
  chemically synthesized
tcatttcttttaagtttcttcc

SEQ ID NO: 1404667 - DNA, 22 bp, Artificial Sequence
  chemically synthesized
actactaactggaagaaactta

SEQ ID NO: 1404668 - DNA, 22 bp, Artificial Sequence
  chemically synthesized
ctactaactggaagaaacttaa

SEQ ID NO: 1404669 - DNA, 22 bp, Artificial Sequence
  chemically synthesized
ctaactggaagaaacttaaaag

SEQ ID NO: 1404670 - DNA, 22 bp, Artificial Sequence
  chemically synthesized
actggaagaaacttaaaagaaa

SEQ ID NO: 1404671 - DNA, 22 bp, Artificial Sequence
  chemically synthesized
tagagaaattgtcatttctttt

SEQ ID NO: 1404672 - DNA, 22 bp, Artificial Sequence
  chemically synthesized
atagagaaattgtcatttcttt

SEQ ID NO: 1404673 - DNA, 22 bp, Artificial Sequence
  chemically synthesized
gaagaaacttaaaagaaatgac

SEQ ID NO: 1404674 - DNA, 22 bp, Artificial Sequence
  chemically synthesized
aaaagaaatgacaatttctcta

SEQ ID NO: 1404675 - DNA, 22 bp, Artificial Sequence
  chemically synthesized
aaagaaatgacaatttctctat

SEQ ID NO: 1404676 - DNA, 22 bp, Artificial Sequence
  chemically synthesized
aaagatgaggaaagtgtgactt

SEQ ID NO: 1404677 - DNA, 22 bp, Artificial Sequence
  chemically synthesized
gaaagatgaggaaagtgtgact

SEQ ID NO: 1404678 - DNA, 22 bp, Artificial Sequence
  chemically synthesized
gtttgaaagatgaggaaagtgt

SEQ ID NO: 1404679 - DNA, 22 bp, Artificial Sequence
  chemically synthesized
ctctataagtcacactttcctc

SEQ ID NO: 1404680 - DNA, 22 bp, Artificial Sequence
  chemically synthesized
agtttgaaagatgaggaaagtg

SEQ ID NO: 1404681 - DNA, 22 bp, Artificial Sequence
  chemically synthesized
tctataagtcacactttcctca

SEQ ID NO: 1404682 - DNA, 22 bp, Artificial Sequence
  chemically synthesized
tataagtcacactttcctcatc

SEQ ID NO: 1404683 - DNA, 22 bp, Artificial Sequence
  chemically synthesized
taagtcacactttcctcatctt

SEQ ID NO: 1404684 - DNA, 22 bp, Artificial Sequence
  chemically synthesized
gtcccatatcttagtttgaaag

SEQ ID NO: 1404685 - DNA, 22 bp, Artificial Sequence
  chemically synthesized
agtcccatatcttagtttgaaa

SEQ ID NO: 1404686 - DNA, 22 bp, Artificial Sequence
  chemically synthesized
tcctcatctttcaaactaagat

SEQ ID NO: 1404687 - DNA, 22 bp, Artificial Sequence
  chemically synthesized
cctcatctttcaaactaagata

SEQ ID NO: 1404688 - DNA, 22 bp, Artificial Sequence
  chemically synthesized
ctcatctttcaaactaagatat

SEQ ID NO: 1404689 - DNA, 22 bp, Artificial Sequence
  chemically synthesized
atctttcaaactaagatatggg

SEQ ID NO: 1404690 - DNA, 22 bp, Artificial Sequence
  chemically synthesized
aagaatatttagtcccatatct

SEQ ID NO: 1404691 - DNA, 22 bp, Artificial Sequence
  chemically synthesized
tcaaactaagatatgggactaa

SEQ ID NO: 1404692 - DNA, 22 bp, Artificial Sequence
  chemically synthesized
caaactaagatatgggactaaa

SEQ ID NO: 1404693 - DNA, 22 bp, Artificial Sequence
  chemically synthesized
aaactaagatatgggactaaat

SEQ ID NO: 1404694 - DNA, 22 bp, Artificial Sequence
  chemically synthesized
agatatgggactaaatattctt

SEQ ID NO: 1404695 - DNA, 22 bp, Artificial Sequence
  chemically synthesized
aaaacccggagaccattaaaga

SEQ ID NO: 1404696 - DNA, 22 bp, Artificial Sequence
  chemically synthesized
caaaacccggagaccattaaag

SEQ ID NO: 1404697 - DNA, 22 bp, Artificial Sequence
  chemically synthesized
aatattctttaatggtctccgg

SEQ ID NO: 1404698 - DNA, 22 bp, Artificial Sequence
  chemically synthesized
gaatttcaaaacccggagacca

SEQ ID NO: 1404699 - DNA, 22 bp, Artificial Sequence
  chemically synthesized
agaatttcaaaacccggagacc

SEQ ID NO: 1404700 - DNA, 22 bp, Artificial Sequence
  chemically synthesized
tttaatggtctccgggttttga

SEQ ID NO: 1404701 - DNA, 22 bp, Artificial Sequence
  chemically synthesized
taatggtctccgggttttgaaa

SEQ ID NO: 1404702 - DNA, 22 bp, Artificial Sequence
  chemically synthesized
aatggtctccgggttttgaaat

SEQ ID NO: 1404703 - DNA, 22 bp, Artificial Sequence
  chemically synthesized
taggaacttagaatttcaaaac

SEQ ID NO: 1404704 - DNA, 22 bp, Artificial Sequence
  chemically synthesized
atggtctccgggttttgaaatt

SEQ ID NO: 1404705 - DNA, 22 bp, Artificial Sequence
  chemically synthesized
ataggaacttagaatttcaaaa

SEQ ID NO: 1404706 - DNA, 22 bp, Artificial Sequence
  chemically synthesized
tataggaacttagaatttcaaa

SEQ ID NO: 1404707 - DNA, 22 bp, Artificial Sequence
  chemically synthesized
ttataggaacttagaatttcaa

SEQ ID NO: 1404708 - DNA, 22 bp, Artificial Sequence
  chemically synthesized
cgggttttgaaattctaagttc

SEQ ID NO: 1404709 - DNA, 22 bp, Artificial Sequence
  chemically synthesized
gacagatatcttttataggaac

SEQ ID NO: 1404710 - DNA, 22 bp, Artificial Sequence
  chemically synthesized
tgaaattctaagttcctataaa

SEQ ID NO: 1404711 - DNA, 22 bp, Artificial Sequence
  chemically synthesized
gaaattctaagttcctataaaa

SEQ ID NO: 1404712 - DNA, 22 bp, Artificial Sequence
  chemically synthesized
aaattctaagttcctataaaag

SEQ ID NO: 1404713 - DNA, 22 bp, Artificial Sequence
  chemically synthesized
taagttcctataaaagatatct

SEQ ID NO: 1404714 - DNA, 22 bp, Artificial Sequence
  chemically synthesized
caaacatctagacagatatctt

SEQ ID NO: 1404715 - DNA, 22 bp, Artificial Sequence
  chemically synthesized
agttcctataaaagatatctgt

SEQ ID NO: 1404716 - DNA, 22 bp, Artificial Sequence
  chemically synthesized
ctataaaagatatctgtctaga

SEQ ID NO: 1404717 - DNA, 22 bp, Artificial Sequence
  chemically synthesized
taaaagatatctgtctagatgt

SEQ ID NO: 1404718 - DNA, 22 bp, Artificial Sequence
  chemically synthesized
tatgtgttgcaaacatctagac

SEQ ID NO: 1404719 - DNA, 22 bp, Artificial Sequence
  chemically synthesized
ttgtatgtgttgcaaacatcta

SEQ ID NO: 1404720 - DNA, 22 bp, Artificial Sequence
  chemically synthesized
attgtatgtgttgcaaacatct

SEQ ID NO: 1404721 - DNA, 22 bp, Artificial Sequence
  chemically synthesized
catttattgtatgtgttgcaaa

SEQ ID NO: 1404722 - DNA, 22 bp, Artificial Sequence
  chemically synthesized
tctagatgtttgcaacacatac

SEQ ID NO: 1404723 - DNA, 22 bp, Artificial Sequence
  chemically synthesized
gatgtttgcaacacatacaata

SEQ ID NO: 1404724 - DNA, 22 bp, Artificial Sequence
  chemically synthesized
tatggtccctacatttattgta

SEQ ID NO: 1404725 - DNA, 22 bp, Artificial Sequence
  chemically synthesized
atatggtccctacatttattgt

SEQ ID NO: 1404726 - DNA, 22 bp, Artificial Sequence
  chemically synthesized
tatatggtccctacatttattg

SEQ ID NO: 1404727 - DNA, 22 bp, Artificial Sequence
  chemically synthesized
ttatatggtccctacatttatt

SEQ ID NO: 1404728 - DNA, 22 bp, Artificial Sequence
  chemically synthesized
gcaacacatacaataaatgtag

SEQ ID NO: 1404729 - DNA, 22 bp, Artificial Sequence
  chemically synthesized
caacacatacaataaatgtagg

SEQ ID NO: 1404730 - DNA, 22 bp, Artificial Sequence
  chemically synthesized
catttttatatggtccctacat

SEQ ID NO: 1404731 - DNA, 22 bp, Artificial Sequence
  chemically synthesized
acatttttatatggtccctaca

SEQ ID NO: 1404732 - DNA, 22 bp, Artificial Sequence
  chemically synthesized
tacatttttatatggtccctac

SEQ ID NO: 1404733 - DNA, 22 bp, Artificial Sequence
  chemically synthesized
taggtatgagatctttacattt

SEQ ID NO: 1404734 - DNA, 22 bp, Artificial Sequence
  chemically synthesized
ataggtatgagatctttacatt

SEQ ID NO: 1404735 - DNA, 22 bp, Artificial Sequence
  chemically synthesized
tataggtatgagatctttacat

SEQ ID NO: 1404736 - DNA, 22 bp, Artificial Sequence
  chemically synthesized
ttataggtatgagatctttaca

SEQ ID NO: 1404737 - DNA, 22 bp, Artificial Sequence
  chemically synthesized
gtttttataggtatgagatctt

SEQ ID NO: 1404738 - DNA, 22 bp, Artificial Sequence
  chemically synthesized
ggtttttataggtatgagatct

SEQ ID NO: 1404739 - DNA, 22 bp, Artificial Sequence
  chemically synthesized
tggtttttataggtatgagatc

SEQ ID NO: 1404740 - DNA, 22 bp, Artificial Sequence
  chemically synthesized
caattttggtttttataggtat

SEQ ID NO: 1404741 - DNA, 22 bp, Artificial Sequence
  chemically synthesized
acaattttggtttttataggta

SEQ ID NO: 1404742 - DNA, 22 bp, Artificial Sequence
  chemically synthesized
atttacaattttggtttttata

SEQ ID NO: 1404743 - DNA, 22 bp, Artificial Sequence
  chemically synthesized
ttgatttacaattttggttttt

SEQ ID NO: 1404744 - DNA, 22 bp, Artificial Sequence
  chemically synthesized
tattgatttacaattttggttt

SEQ ID NO: 1404745 - DNA, 22 bp, Artificial Sequence
  chemically synthesized
ctattgatttacaattttggtt

SEQ ID NO: 1404746 - DNA, 22 bp, Artificial Sequence
  chemically synthesized
atacctataaaaaccaaaattg

SEQ ID NO: 1404747 - DNA, 22 bp, Artificial Sequence
  chemically synthesized
tctattgatttacaattttggt

SEQ ID NO: 1404748 - DNA, 22 bp, Artificial Sequence
  chemically synthesized
ttctattgatttacaattttgg

SEQ ID NO: 1404749 - DNA, 22 bp, Artificial Sequence
  chemically synthesized
atttttctattgatttacaatt

SEQ ID NO: 1404750 - DNA, 22 bp, Artificial Sequence
  chemically synthesized
taaaaaccaaaattgtaaatca

SEQ ID NO: 1404751 - DNA, 22 bp, Artificial Sequence
  chemically synthesized
atgctcatttttctattgattt

SEQ ID NO: 1404752 - DNA, 22 bp, Artificial Sequence
  chemically synthesized
atctcatgctcatttttctatt

SEQ ID NO: 1404753 - DNA, 22 bp, Artificial Sequence
  chemically synthesized
taatctcatgctcatttttcta

SEQ ID NO: 1404754 - DNA, 22 bp, Artificial Sequence
  chemically synthesized
ctaatctcatgctcatttttct

SEQ ID NO: 1404755 - DNA, 22 bp, Artificial Sequence
  chemically synthesized
tctaatctcatgctcatttttc

SEQ ID NO: 1404756 - DNA, 22 bp, Artificial Sequence
  chemically synthesized
ttctaatctcatgctcattttt

SEQ ID NO: 1404757 - DNA, 22 bp, Artificial Sequence
  chemically synthesized
taaatcaatagaaaaatgagca

SEQ ID NO: 1404758 - DNA, 22 bp, Artificial Sequence
  chemically synthesized
taacacaaatatataaaagtgc

SEQ ID NO: 1404759 - DNA, 22 bp, Artificial Sequence
  chemically synthesized
gaaaagtgcacttttatatatt

SEQ ID NO: 1404760 - DNA, 22 bp, Artificial Sequence
  chemically synthesized
aactataacacaaatatataaa

SEQ ID NO: 1404761 - DNA, 22 bp, Artificial Sequence
  chemically synthesized
ctgaactataacacaaatatat

SEQ ID NO: 1404762 - DNA, 22 bp, Artificial Sequence
  chemically synthesized
actgaactataacacaaatata

SEQ ID NO: 1404763 - DNA, 22 bp, Artificial Sequence
  chemically synthesized
tactgaactataacacaaatat

SEQ ID NO: 1404764 - DNA, 22 bp, Artificial Sequence
  chemically synthesized
ttatatatttgtgttatagttc

SEQ ID NO: 1404765 - DNA, 22 bp, Artificial Sequence
  chemically synthesized
aaatgttttactgaactataac

SEQ ID NO: 1404766 - DNA, 22 bp, Artificial Sequence
  chemically synthesized
tatatatttgtgttatagttca

SEQ ID NO: 1404767 - DNA, 22 bp, Artificial Sequence
  chemically synthesized
aaaatgttttactgaactataa

SEQ ID NO: 1404768 - DNA, 22 bp, Artificial Sequence
  chemically synthesized
atatatttgtgttatagttcag

SEQ ID NO: 1404769 - DNA, 22 bp, Artificial Sequence
  chemically synthesized
taaaatgttttactgaactata

SEQ ID NO: 1404770 - DNA, 22 bp, Artificial Sequence
  chemically synthesized
tatatttgtgttatagttcagt

SEQ ID NO: 1404771 - DNA, 22 bp, Artificial Sequence
  chemically synthesized
ttaaaatgttttactgaactat

SEQ ID NO: 1404772 - DNA, 22 bp, Artificial Sequence
  chemically synthesized
atttttaaaatgttttactgaa

SEQ ID NO: 1404773 - DNA, 22 bp, Artificial Sequence
  chemically synthesized
gatttttaaaatgttttactga

SEQ ID NO: 1404774 - DNA, 22 bp, Artificial Sequence
  chemically synthesized
gtgttatagttcagtaaaacat

SEQ ID NO: 1404775 - DNA, 22 bp, Artificial Sequence
  chemically synthesized
tgttatagttcagtaaaacatt

SEQ ID NO: 1404776 - DNA, 22 bp, Artificial Sequence
  chemically synthesized
tcaacttgatttttaaaatgtt

SEQ ID NO: 1404777 - DNA, 22 bp, Artificial Sequence
  chemically synthesized
tagttcagtaaaacattttaaa

SEQ ID NO: 1404778 - DNA, 22 bp, Artificial Sequence
  chemically synthesized
tatcaacttgatttttaaaatg

SEQ ID NO: 1404779 - DNA, 22 bp, Artificial Sequence
  chemically synthesized
agtaaaacattttaaaaatcaa

SEQ ID NO: 1404780 - DNA, 22 bp, Artificial Sequence
  chemically synthesized
aagaaagtaattctatcaactt

SEQ ID NO: 1404781 - DNA, 22 bp, Artificial Sequence
  chemically synthesized
taaaaatcaagttgatagaatt

SEQ ID NO: 1404782 - DNA, 22 bp, Artificial Sequence
  chemically synthesized
aaaaatcaagttgatagaatta

SEQ ID NO: 1404783 - DNA, 22 bp, Artificial Sequence
  chemically synthesized
aaaatcaagttgatagaattac

SEQ ID NO: 1404784 - DNA, 22 bp, Artificial Sequence
  chemically synthesized
tagattaaagaaagtaattcta

SEQ ID NO: 1404785 - DNA, 22 bp, Artificial Sequence
  chemically synthesized
gtagattaaagaaagtaattct

SEQ ID NO: 1404786 - DNA, 22 bp, Artificial Sequence
  chemically synthesized
tgtagattaaagaaagtaattc

SEQ ID NO: 1404787 - DNA, 22 bp, Artificial Sequence
  chemically synthesized
cctttgtagattaaagaaagta

SEQ ID NO: 1404788 - DNA, 22 bp, Artificial Sequence
  chemically synthesized
ccctttgtagattaaagaaagt

SEQ ID NO: 1404789 - DNA, 22 bp, Artificial Sequence
  chemically synthesized
atagaattactttctttaatct

SEQ ID NO: 1404790 - DNA, 22 bp, Artificial Sequence
  chemically synthesized
gtaatttccctttgtagattaa

SEQ ID NO: 1404791 - DNA, 22 bp, Artificial Sequence
  chemically synthesized
attagtaatttccctttgtaga

SEQ ID NO: 1404792 - DNA, 22 bp, Artificial Sequence
  chemically synthesized
cattagtaatttccctttgtag

SEQ ID NO: 1404793 - DNA, 22 bp, Artificial Sequence
  chemically synthesized
ctttctttaatctacaaaggga

SEQ ID NO: 1404794 - DNA, 22 bp, Artificial Sequence
  chemically synthesized
tcattagtaatttccctttgta

SEQ ID NO: 1404795 - DNA, 22 bp, Artificial Sequence
  chemically synthesized
tctttaatctacaaagggaaat

SEQ ID NO: 1404796 - DNA, 22 bp, Artificial Sequence
  chemically synthesized
ctttaatctacaaagggaaatt

SEQ ID NO: 1404797 - DNA, 22 bp, Artificial Sequence
  chemically synthesized
tttaatctacaaagggaaatta

SEQ ID NO: 1404798 - DNA, 22 bp, Artificial Sequence
  chemically synthesized
taatctacaaagggaaattact

SEQ ID NO: 1404799 - DNA, 22 bp, Artificial Sequence
  chemically synthesized
ccaactttcattagtaatttcc

SEQ ID NO: 1404800 - DNA, 22 bp, Artificial Sequence
  chemically synthesized
aatctacaaagggaaattacta

SEQ ID NO: 1404801 - DNA, 22 bp, Artificial Sequence
  chemically synthesized
atctacaaagggaaattactaa

SEQ ID NO: 1404802 - DNA, 22 bp, Artificial Sequence
  chemically synthesized
ctcccaactttcattagtaatt

SEQ ID NO: 1404803 - DNA, 22 bp, Artificial Sequence
  chemically synthesized
cctcccaactttcattagtaat

SEQ ID NO: 1404804 - DNA, 22 bp, Artificial Sequence
  chemically synthesized
caaagggaaattactaatgaaa

SEQ ID NO: 1404805 - DNA, 22 bp, Artificial Sequence
  chemically synthesized
ctaatgaaagttgggaggaaat

SEQ ID NO: 1404806 - DNA, 22 bp, Artificial Sequence
  chemically synthesized
tagtaaggataacatttcctcc

SEQ ID NO: 1404807 - DNA, 22 bp, Artificial Sequence
  chemically synthesized
atgaaagttgggaggaaatgtt

SEQ ID NO: 1404808 - DNA, 22 bp, Artificial Sequence
  chemically synthesized
tctatagtaaggataacatttc

SEQ ID NO: 1404809 - DNA, 22 bp, Artificial Sequence
  chemically synthesized
ggaggaaatgttatccttacta

SEQ ID NO: 1404810 - DNA, 22 bp, Artificial Sequence
  chemically synthesized
atgtggatgttatctatagtaa

SEQ ID NO: 1404811 - DNA, 22 bp, Artificial Sequence
  chemically synthesized
ctcatgtggatgttatctatag

SEQ ID NO: 1404812 - DNA, 22 bp, Artificial Sequence
  chemically synthesized
ttgctcatgtggatgttatcta

SEQ ID NO: 1404813 - DNA, 22 bp, Artificial Sequence
  chemically synthesized
attgctcatgtggatgttatct

SEQ ID NO: 1404814 - DNA, 22 bp, Artificial Sequence
  chemically synthesized
tccttactatagataacatcca

SEQ ID NO: 1404815 - DNA, 22 bp, Artificial Sequence
  chemically synthesized
tgtttattgctcatgtggatgt

SEQ ID NO: 1404816 - DNA, 22 bp, Artificial Sequence
  chemically synthesized
gtgtttattgctcatgtggatg

SEQ ID NO: 1404817 - DNA, 22 bp, Artificial Sequence
  chemically synthesized
actatagataacatccacatga

SEQ ID NO: 1404818 - DNA, 22 bp, Artificial Sequence
  chemically synthesized
tgtgtttattgctcatgtggat

SEQ ID NO: 1404819 - DNA, 22 bp, Artificial Sequence
  chemically synthesized
ctatagataacatccacatgag

SEQ ID NO: 1404820 - DNA, 22 bp, Artificial Sequence
  chemically synthesized
ttgtgtttattgctcatgtgga

SEQ ID NO: 1404821 - DNA, 22 bp, Artificial Sequence
  chemically synthesized
tttgtgtttattgctcatgtgg

SEQ ID NO: 1404822 - DNA, 22 bp, Artificial Sequence
  chemically synthesized
tagataacatccacatgagcaa

SEQ ID NO: 1404823 - DNA, 22 bp, Artificial Sequence
  chemically synthesized
agaaccattttttgtgtttatt

SEQ ID NO: 1404824 - DNA, 22 bp, Artificial Sequence
  chemically synthesized
gagaaccattttttgtgtttat

SEQ ID NO: 1404825 - DNA, 22 bp, Artificial Sequence
  chemically synthesized
atttgagaaccattttttgtgt

SEQ ID NO: 1404826 - DNA, 22 bp, Artificial Sequence
  chemically synthesized
attaatttgagaaccatttttt

SEQ ID NO: 1404827 - DNA, 22 bp, Artificial Sequence
  chemically synthesized
gtgactaattaatttgagaacc

SEQ ID NO: 1404828 - DNA, 22 bp, Artificial Sequence
  chemically synthesized
tagtgactaattaatttgagaa

SEQ ID NO: 1404829 - DNA, 22 bp, Artificial Sequence
  chemically synthesized
ctagtgactaattaatttgaga

SEQ ID NO: 1404830 - DNA, 22 bp, Artificial Sequence
  chemically synthesized
tctagtgactaattaatttgag

SEQ ID NO: 1404831 - DNA, 22 bp, Artificial Sequence
  chemically synthesized
ttctagtgactaattaatttga

SEQ ID NO: 1404832 - DNA, 22 bp, Artificial Sequence
  chemically synthesized
tttctagtgactaattaatttg

SEQ ID NO: 1404833 - DNA, 22 bp, Artificial Sequence
  chemically synthesized
ttttctagtgactaattaattt

SEQ ID NO: 1404834 - DNA, 22 bp, Artificial Sequence
  chemically synthesized
catttttttctagtgactaatt

SEQ ID NO: 1404835 - DNA, 22 bp, Artificial Sequence
  chemically synthesized
ccatttttttctagtgactaat

SEQ ID NO: 1404836 - DNA, 22 bp, Artificial Sequence
  chemically synthesized
tcaaattaattagtcactagaa

SEQ ID NO: 1404837 - DNA, 22 bp, Artificial Sequence
  chemically synthesized
atttccatttttttctagtgac

SEQ ID NO: 1404838 - DNA, 22 bp, Artificial Sequence
  chemically synthesized
aaattaattagtcactagaaaa

SEQ ID NO: 1404839 - DNA, 22 bp, Artificial Sequence
  chemically synthesized
tcatttccatttttttctagtg

SEQ ID NO: 1404840 - DNA, 22 bp, Artificial Sequence
  chemically synthesized
ctcatttccatttttttctagt

SEQ ID NO: 1404841 - DNA, 22 bp, Artificial Sequence
  chemically synthesized
attagtcactagaaaaaaatgg

SEQ ID NO: 1404842 - DNA, 22 bp, Artificial Sequence
  chemically synthesized
tgtttctcatttccattttttt

SEQ ID NO: 1404843 - DNA, 22 bp, Artificial Sequence
  chemically synthesized
gtcactagaaaaaaatggaaat

SEQ ID NO: 1404844 - DNA, 22 bp, Artificial Sequence
  chemically synthesized
attgtgtttctcatttccattt

SEQ ID NO: 1404845 - DNA, 22 bp, Artificial Sequence
  chemically synthesized
gaaaaaaatggaaatgagaaac

SEQ ID NO: 1404846 - DNA, 22 bp, Artificial Sequence
  chemically synthesized
tagtatctcattgtgtttctca

SEQ ID NO: 1404847 - DNA, 22 bp, Artificial Sequence
  chemically synthesized
tactatagtatctcattgtgtt

SEQ ID NO: 1404848 - DNA, 22 bp, Artificial Sequence
  chemically synthesized
ttatactatagtatctcattgt

SEQ ID NO: 1404849 - DNA, 22 bp, Artificial Sequence
  chemically synthesized
gctgttatactatagtatctca

SEQ ID NO: 1404850 - DNA, 22 bp, Artificial Sequence
  chemically synthesized
tggctgttatactatagtatct

SEQ ID NO: 1404851 - DNA, 22 bp, Artificial Sequence
  chemically synthesized
ctggctgttatactatagtatc

SEQ ID NO: 1404852 - DNA, 22 bp, Artificial Sequence
  chemically synthesized
tctggctgttatactatagtat

SEQ ID NO: 1404853 - DNA, 22 bp, Artificial Sequence
  chemically synthesized
agcctttctggctgttatacta

SEQ ID NO: 1404854 - DNA, 22 bp, Artificial Sequence
  chemically synthesized
cagcctttctggctgttatact

SEQ ID NO: 1404855 - DNA, 22 bp, Artificial Sequence
  chemically synthesized
atttcagcctttctggctgtta

SEQ ID NO: 1404856 - DNA, 22 bp, Artificial Sequence
  chemically synthesized
aatttcagcctttctggctgtt

SEQ ID NO: 1404857 - DNA, 22 bp, Artificial Sequence
  chemically synthesized
taatttcagcctttctggctgt

SEQ ID NO: 1404858 - DNA, 22 bp, Artificial Sequence
  chemically synthesized
tagtataacagccagaaaggct

SEQ ID NO: 1404859 - DNA, 22 bp, Artificial Sequence
  chemically synthesized
gtctttaatttcagcctttctg

SEQ ID NO: 1404860 - DNA, 22 bp, Artificial Sequence
  chemically synthesized
ttagtctttaatttcagccttt

SEQ ID NO: 1404861 - DNA, 22 bp, Artificial Sequence
  chemically synthesized
gcattattagtctttaatttca

SEQ ID NO: 1404862 - DNA, 22 bp, Artificial Sequence
  chemically synthesized
agcattattagtctttaatttc

SEQ ID NO: 1404863 - DNA, 22 bp, Artificial Sequence
  chemically synthesized
aaattaaagactaataatgcta

SEQ ID NO: 1404864 - DNA, 22 bp, Artificial Sequence
  chemically synthesized
gacatgtcaatgcttagcatta

SEQ ID NO: 1404865 - DNA, 22 bp, Artificial Sequence
  chemically synthesized
tggacatgtcaatgcttagcat

SEQ ID NO: 1404866 - DNA, 22 bp, Artificial Sequence
  chemically synthesized
aagactaataatgctaagcatt

SEQ ID NO: 1404867 - DNA, 22 bp, Artificial Sequence
  chemically synthesized
ataatgctaagcattgacatgt

SEQ ID NO: 1404868 - DNA, 22 bp, Artificial Sequence
  chemically synthesized
tagaagttctggacatgtcaat

SEQ ID NO: 1404869 - DNA, 22 bp, Artificial Sequence
  chemically synthesized
atagaagttctggacatgtcaa

SEQ ID NO: 1404870 - DNA, 22 bp, Artificial Sequence
  chemically synthesized
tatagaagttctggacatgtca

SEQ ID NO: 1404871 - DNA, 22 bp, Artificial Sequence
  chemically synthesized
ctttatagaagttctggacatg

SEQ ID NO: 1404872 - DNA, 22 bp, Artificial Sequence
  chemically synthesized
agcattgacatgtccagaactt

SEQ ID NO: 1404873 - DNA, 22 bp, Artificial Sequence
  chemically synthesized
acatgtccagaacttctataaa

SEQ ID NO: 1404874 - DNA, 22 bp, Artificial Sequence
  chemically synthesized
ctataaagtaatgatggttctt

SEQ ID NO: 1404875 - DNA, 22 bp, Artificial Sequence
  chemically synthesized
tataaagtaatgatggttcttt

SEQ ID NO: 1404876 - DNA, 22 bp, Artificial Sequence
  chemically synthesized
aaggtaggtaaacaaagaacca

SEQ ID NO: 1404877 - DNA, 22 bp, Artificial Sequence
  chemically synthesized
taaagtaatgatggttctttgt

SEQ ID NO: 1404878 - DNA, 22 bp, Artificial Sequence
  chemically synthesized
caaggtaggtaaacaaagaacc

SEQ ID NO: 1404879 - DNA, 22 bp, Artificial Sequence
  chemically synthesized
tcaaggtaggtaaacaaagaac

SEQ ID NO: 1404880 - DNA, 22 bp, Artificial Sequence
  chemically synthesized
ttcaaggtaggtaaacaaagaa

SEQ ID NO: 1404881 - DNA, 22 bp, Artificial Sequence
  chemically synthesized
tttgtttacctaccttgaaaaa

SEQ ID NO: 1404882 - DNA, 22 bp, Artificial Sequence
  chemically synthesized
tgtttacctaccttgaaaaact

SEQ ID NO: 1404883 - DNA, 22 bp, Artificial Sequence
  chemically synthesized
aaaatgccacgtagtttttcaa

SEQ ID NO: 1404884 - DNA, 22 bp, Artificial Sequence
  chemically synthesized
gtttacctaccttgaaaaacta

SEQ ID NO: 1404885 - DNA, 22 bp, Artificial Sequence
  chemically synthesized
tttacctaccttgaaaaactac

SEQ ID NO: 1404886 - DNA, 22 bp, Artificial Sequence
  chemically synthesized
gttgaaaatgccacgtagtttt

SEQ ID NO: 1404887 - DNA, 22 bp, Artificial Sequence
  chemically synthesized
acctaccttgaaaaactacgtg

SEQ ID NO: 1404888 - DNA, 22 bp, Artificial Sequence
  chemically synthesized
agttgaaaatgccacgtagttt

SEQ ID NO: 1404889 - DNA, 22 bp, Artificial Sequence
  chemically synthesized
cctaccttgaaaaactacgtgg

SEQ ID NO: 1404890 - DNA, 22 bp, Artificial Sequence
  chemically synthesized
tagttgaaaatgccacgtagtt

SEQ ID NO: 1404891 - DNA, 22 bp, Artificial Sequence
  chemically synthesized
ccttgaaaaactacgtggcatt

SEQ ID NO: 1404892 - DNA, 22 bp, Artificial Sequence
  chemically synthesized
atctttagttgaaaatgccacg

SEQ ID NO: 1404893 - DNA, 22 bp, Artificial Sequence
  chemically synthesized
gaaaaactacgtggcattttca

SEQ ID NO: 1404894 - DNA, 22 bp, Artificial Sequence
  chemically synthesized
aaaaactacgtggcattttcaa

SEQ ID NO: 1404895 - DNA, 22 bp, Artificial Sequence
  chemically synthesized
cgtggcattttcaactaaagat

SEQ ID NO: 1404896 - DNA, 22 bp, Artificial Sequence
  chemically synthesized
tcaactaaagatgagtatttca

SEQ ID NO: 1404897 - DNA, 22 bp, Artificial Sequence
  chemically synthesized
caactaaagatgagtatttcac

SEQ ID NO: 1404898 - DNA, 22 bp, Artificial Sequence
  chemically synthesized
ggtcatagaatagtgaaatact

SEQ ID NO: 1404899 - DNA, 22 bp, Artificial Sequence
  chemically synthesized
aactaaagatgagtatttcact

SEQ ID NO: 1404900 - DNA, 22 bp, Artificial Sequence
  chemically synthesized
ttaggtcatagaatagtgaaat

SEQ ID NO: 1404901 - DNA, 22 bp, Artificial Sequence
  chemically synthesized
aagatgagtatttcactattct

SEQ ID NO: 1404902 - DNA, 22 bp, Artificial Sequence
  chemically synthesized
cactattctatgacctaataat

SEQ ID NO: 1404903 - DNA, 22 bp, Artificial Sequence
  chemically synthesized
actattctatgacctaataatt

SEQ ID NO: 1404904 - DNA, 22 bp, Artificial Sequence
  chemically synthesized
tgtgccaagaagtagaattatt

SEQ ID NO: 1404905 - DNA, 22 bp, Artificial Sequence
  chemically synthesized
ttctatgacctaataattctac

SEQ ID NO: 1404906 - DNA, 22 bp, Artificial Sequence
  chemically synthesized
ttatgtgccaagaagtagaatt

SEQ ID NO: 1404907 - DNA, 22 bp, Artificial Sequence
  chemically synthesized
tatgacctaataattctacttc

SEQ ID NO: 1404908 - DNA, 22 bp, Artificial Sequence
  chemically synthesized
tgttatgtgccaagaagtagaa

SEQ ID NO: 1404909 - DNA, 22 bp, Artificial Sequence
  chemically synthesized
tgacctaataattctacttctt

SEQ ID NO: 1404910 - DNA, 22 bp, Artificial Sequence
  chemically synthesized
ataattctacttcttggcacat

SEQ ID NO: 1404911 - DNA, 22 bp, Artificial Sequence
  chemically synthesized
tacttcttggcacataacagaa

SEQ ID NO: 1404912 - DNA, 22 bp, Artificial Sequence
  chemically synthesized
cttcttggcacataacagaact

SEQ ID NO: 1404913 - DNA, 22 bp, Artificial Sequence
  chemically synthesized
cacatatgcatgtagttctgtt

SEQ ID NO: 1404914 - DNA, 22 bp, Artificial Sequence
  chemically synthesized
cttggcacataacagaactaca

SEQ ID NO: 1404915 - DNA, 22 bp, Artificial Sequence
  chemically synthesized
ttggcacataacagaactacat

SEQ ID NO: 1404916 - DNA, 22 bp, Artificial Sequence
  chemically synthesized
ctgcacatatgcatgtagttct

SEQ ID NO: 1404917 - DNA, 22 bp, Artificial Sequence
  chemically synthesized
actgcacatatgcatgtagttc

SEQ ID NO: 1404918 - DNA, 22 bp, Artificial Sequence
  chemically synthesized
ggcacataacagaactacatgc

SEQ ID NO: 1404919 - DNA, 22 bp, Artificial Sequence
  chemically synthesized
gcacataacagaactacatgca

SEQ ID NO: 1404920 - DNA, 22 bp, Artificial Sequence
  chemically synthesized
caaatttactgcacatatgcat

SEQ ID NO: 1404921 - DNA, 22 bp, Artificial Sequence
  chemically synthesized
gcaaatttactgcacatatgca

SEQ ID NO: 1404922 - DNA, 22 bp, Artificial Sequence
  chemically synthesized
ttgcaaatttactgcacatatg

SEQ ID NO: 1404923 - DNA, 22 bp, Artificial Sequence
  chemically synthesized
aatattcttgcaaatttactgc

SEQ ID NO: 1404924 - DNA, 22 bp, Artificial Sequence
  chemically synthesized
catgcatatgtgcagtaaattt

SEQ ID NO: 1404925 - DNA, 22 bp, Artificial Sequence
  chemically synthesized
gaatattcttgcaaatttactg

SEQ ID NO: 1404926 - DNA, 22 bp, Artificial Sequence
  chemically synthesized
tgaatattcttgcaaatttact

SEQ ID NO: 1404927 - DNA, 22 bp, Artificial Sequence
  chemically synthesized
cactttgaatattcttgcaaat

SEQ ID NO: 1404928 - DNA, 22 bp, Artificial Sequence
  chemically synthesized
aaaataattccactttgaatat

SEQ ID NO: 1404929 - DNA, 22 bp, Artificial Sequence
  chemically synthesized
aaaaataattccactttgaata

SEQ ID NO: 1404930 - DNA, 22 bp, Artificial Sequence
  chemically synthesized
ttaaaaataattccactttgaa

SEQ ID NO: 1404931 - DNA, 22 bp, Artificial Sequence
  chemically synthesized
gcaagaatattcaaagtggaat

SEQ ID NO: 1404932 - DNA, 22 bp, Artificial Sequence
  chemically synthesized
caagaatattcaaagtggaatt

SEQ ID NO: 1404933 - DNA, 22 bp, Artificial Sequence
  chemically synthesized
tgaactcttaaaaataattcca

SEQ ID NO: 1404934 - DNA, 22 bp, Artificial Sequence
  chemically synthesized
gtgaactcttaaaaataattcc

SEQ ID NO: 1404935 - DNA, 22 bp, Artificial Sequence
  chemically synthesized
catttgtgaactcttaaaaata

SEQ ID NO: 1404936 - DNA, 22 bp, Artificial Sequence
  chemically synthesized
aaagtggaattatttttaagag

SEQ ID NO: 1404937 - DNA, 22 bp, Artificial Sequence
  chemically synthesized
attccatttgtgaactcttaaa

SEQ ID NO: 1404938 - DNA, 22 bp, Artificial Sequence
  chemically synthesized
aattgattccatttgtgaactc

SEQ ID NO: 1404939 - DNA, 22 bp, Artificial Sequence
  chemically synthesized
aaattgattccatttgtgaact

SEQ ID NO: 1404940 - DNA, 22 bp, Artificial Sequence
  chemically synthesized
tttttaagagttcacaaatgga

SEQ ID NO: 1404941 - DNA, 22 bp, Artificial Sequence
  chemically synthesized
ttaagagttcacaaatggaatc

SEQ ID NO: 1404942 - DNA, 22 bp, Artificial Sequence
  chemically synthesized
taagagttcacaaatggaatca

SEQ ID NO: 1404943 - DNA, 22 bp, Artificial Sequence
  chemically synthesized
aagagttcacaaatggaatcaa

SEQ ID NO: 1404944 - DNA, 22 bp, Artificial Sequence
  chemically synthesized
agagttcacaaatggaatcaat

SEQ ID NO: 1404945 - DNA, 22 bp, Artificial Sequence
  chemically synthesized
gatgaacatttaaattgattcc

SEQ ID NO: 1404946 - DNA, 22 bp, Artificial Sequence
  chemically synthesized
tggatgaacatttaaattgatt

SEQ ID NO: 1404947 - DNA, 22 bp, Artificial Sequence
  chemically synthesized
ctctggatgaacatttaaattg

SEQ ID NO: 1404948 - DNA, 22 bp, Artificial Sequence
  chemically synthesized
acaaatggaatcaatttaaatg

SEQ ID NO: 1404949 - DNA, 22 bp, Artificial Sequence
  chemically synthesized
catctactctggatgaacattt

SEQ ID NO: 1404950 - DNA, 22 bp, Artificial Sequence
  chemically synthesized
ttccatctactctggatgaaca

SEQ ID NO: 1404951 - DNA, 22 bp, Artificial Sequence
  chemically synthesized
attccatctactctggatgaac

SEQ ID NO: 1404952 - DNA, 22 bp, Artificial Sequence
  chemically synthesized
cttattccatctactctggatg

SEQ ID NO: 1404953 - DNA, 22 bp, Artificial Sequence
  chemically synthesized
acttattccatctactctggat

SEQ ID NO: 1404954 - DNA, 22 bp, Artificial Sequence
  chemically synthesized
aaatgttcatccagagtagatg

SEQ ID NO: 1404955 - DNA, 22 bp, Artificial Sequence
  chemically synthesized
aatgttcatccagagtagatgg

SEQ ID NO: 1404956 - DNA, 22 bp, Artificial Sequence
  chemically synthesized
taatttacttattccatctact

SEQ ID NO: 1404957 - DNA, 22 bp, Artificial Sequence
  chemically synthesized
atccagagtagatggaataagt

SEQ ID NO: 1404958 - DNA, 22 bp, Artificial Sequence
  chemically synthesized
tgtagtatgccatcatataaat

SEQ ID NO: 1404959 - DNA, 22 bp, Artificial Sequence
  chemically synthesized
taggacatttatatgatggcat

SEQ ID NO: 1404960 - DNA, 22 bp, Artificial Sequence
  chemically synthesized
agtgttgtgtagtatgccatca

SEQ ID NO: 1404961 - DNA, 22 bp, Artificial Sequence
  chemically synthesized
cagtgttgtgtagtatgccatc

SEQ ID NO: 1404962 - DNA, 22 bp, Artificial Sequence
  chemically synthesized
tcagtgttgtgtagtatgccat

SEQ ID NO: 1404963 - DNA, 22 bp, Artificial Sequence
  chemically synthesized
atatgatggcatactacacaac

SEQ ID NO: 1404964 - DNA, 22 bp, Artificial Sequence
  chemically synthesized
tatgatggcatactacacaaca

SEQ ID NO: 1404965 - DNA, 22 bp, Artificial Sequence
  chemically synthesized
tggtcccataattttcagtgtt

SEQ ID NO: 1404966 - DNA, 22 bp, Artificial Sequence
  chemically synthesized
tagttgtggtcccataattttc

SEQ ID NO: 1404967 - DNA, 22 bp, Artificial Sequence
  chemically synthesized
gtagttgtggtcccataatttt

SEQ ID NO: 1404968 - DNA, 22 bp, Artificial Sequence
  chemically synthesized
cacaacactgaaaattatggga

SEQ ID NO: 1404969 - DNA, 22 bp, Artificial Sequence
  chemically synthesized
ttgtagttgtggtcccataatt

SEQ ID NO: 1404970 - DNA, 22 bp, Artificial Sequence
  chemically synthesized
cttgtagttgtggtcccataat

SEQ ID NO: 1404971 - DNA, 22 bp, Artificial Sequence
  chemically synthesized
tttcttgtagttgtggtcccat

SEQ ID NO: 1404972 - DNA, 22 bp, Artificial Sequence
  chemically synthesized
gtttcttgtagttgtggtccca

SEQ ID NO: 1404973 - DNA, 22 bp, Artificial Sequence
  chemically synthesized
atttgtttcttgtagttgtggt

SEQ ID NO: 1404974 - DNA, 22 bp, Artificial Sequence
  chemically synthesized
aaaattatgggaccacaactac

SEQ ID NO: 1404975 - DNA, 22 bp, Artificial Sequence
  chemically synthesized
tctaatttgtttcttgtagttg

SEQ ID NO: 1404976 - DNA, 22 bp, Artificial Sequence
  chemically synthesized
tgggaccacaactacaagaaac

SEQ ID NO: 1404977 - DNA, 22 bp, Artificial Sequence
  chemically synthesized
tgagatctatctaatttgtttc

SEQ ID NO: 1404978 - DNA, 22 bp, Artificial Sequence
  chemically synthesized
gtgagatctatctaatttgttt

SEQ ID NO: 1404979 - DNA, 22 bp, Artificial Sequence
  chemically synthesized
tttgtgagatctatctaatttg

SEQ ID NO: 1404980 - DNA, 22 bp, Artificial Sequence
  chemically synthesized
tgtttgtgagatctatctaatt

SEQ ID NO: 1404981 - DNA, 22 bp, Artificial Sequence
  chemically synthesized
caagaaacaaattagatagatc

SEQ ID NO: 1404982 - DNA, 22 bp, Artificial Sequence
  chemically synthesized
aacattctgtttgtgagatcta

SEQ ID NO: 1404983 - DNA, 22 bp, Artificial Sequence
  chemically synthesized
aatctcaacattctgtttgtga

SEQ ID NO: 1404984 - DNA, 22 bp, Artificial Sequence
  chemically synthesized
ctaaatctcaacattctgtttg

SEQ ID NO: 1404985 - DNA, 22 bp, Artificial Sequence
  chemically synthesized
gatagatctcacaaacagaatg

SEQ ID NO: 1404986 - DNA, 22 bp, Artificial Sequence
  chemically synthesized
gctcctaaatctcaacattctg

SEQ ID NO: 1404987 - DNA, 22 bp, Artificial Sequence
  chemically synthesized
tggctcctaaatctcaacattc

SEQ ID NO: 1404988 - DNA, 22 bp, Artificial Sequence
  chemically synthesized
ctggctcctaaatctcaacatt

SEQ ID NO: 1404989 - DNA, 22 bp, Artificial Sequence
  chemically synthesized
tttctggctcctaaatctcaac

SEQ ID NO: 1404990 - DNA, 22 bp, Artificial Sequence
  chemically synthesized
acaaacagaatgttgagattta

SEQ ID NO: 1404991 - DNA, 22 bp, Artificial Sequence
  chemically synthesized
gtttctggctcctaaatctcaa

SEQ ID NO: 1404992 - DNA, 22 bp, Artificial Sequence
  chemically synthesized
tgtttctggctcctaaatctca

SEQ ID NO: 1404993 - DNA, 22 bp, Artificial Sequence
  chemically synthesized
ttgtttctggctcctaaatctc

SEQ ID NO: 1404994 - DNA, 22 bp, Artificial Sequence
  chemically synthesized
ttttgtttctggctcctaaatc

SEQ ID NO: 1404995 - DNA, 22 bp, Artificial Sequence
  chemically synthesized
tactcttttgtttctggctcct

SEQ ID NO: 1404996 - DNA, 22 bp, Artificial Sequence
  chemically synthesized
agatttaggagccagaaacaaa

SEQ ID NO: 1404997 - DNA, 22 bp, Artificial Sequence
  chemically synthesized
aggagccagaaacaaaagagta

SEQ ID NO: 1404998 - DNA, 22 bp, Artificial Sequence
  chemically synthesized
ggagccagaaacaaaagagtac

SEQ ID NO: 1404999 - DNA, 22 bp, Artificial Sequence
  chemically synthesized
aagccatacagctgtactcttt

SEQ ID NO: 1405000 - DNA, 22 bp, Artificial Sequence
  chemically synthesized
gaagccatacagctgtactctt

SEQ ID NO: 1405001 - DNA, 22 bp, Artificial Sequence
  chemically synthesized
aaatgtatgtacttgaagccat

SEQ ID NO: 1405002 - DNA, 22 bp, Artificial Sequence
  chemically synthesized
ctgaaatgtatgtacttgaagc

SEQ ID NO: 1405003 - DNA, 22 bp, Artificial Sequence
  chemically synthesized
tatggcttcaagtacatacatt

SEQ ID NO: 1405004 - DNA, 22 bp, Artificial Sequence
  chemically synthesized
ggacagacagttcctgaaatgt

SEQ ID NO: 1405005 - DNA, 22 bp, Artificial Sequence
  chemically synthesized
caagtacatacatttcaggaac

SEQ ID NO: 1405006 - DNA, 22 bp, Artificial Sequence
  chemically synthesized
aagtacatacatttcaggaact

SEQ ID NO: 1405007 - DNA, 22 bp, Artificial Sequence
  chemically synthesized
attaggacagacagttcctgaa

SEQ ID NO: 1405008 - DNA, 22 bp, Artificial Sequence
  chemically synthesized
acacaccattgattaggacaga

SEQ ID NO: 1405009 - DNA, 22 bp, Artificial Sequence
  chemically synthesized
caggaactgtctgtcctaatca

SEQ ID NO: 1405010 - DNA, 22 bp, Artificial Sequence
  chemically synthesized
aggaactgtctgtcctaatcaa

SEQ ID NO: 1405011 - DNA, 22 bp, Artificial Sequence
  chemically synthesized
acatctaacacaccattgatta

SEQ ID NO: 1405012 - DNA, 22 bp, Artificial Sequence
  chemically synthesized
tctgtcctaatcaatggtgtgt

SEQ ID NO: 1405013 - DNA, 22 bp, Artificial Sequence
  chemically synthesized
tcctaatcaatggtgtgttaga

SEQ ID NO: 1405014 - DNA, 22 bp, Artificial Sequence
  chemically synthesized
atcaatggtgtgttagatgtca

SEQ ID NO: 1405015 - DNA, 22 bp, Artificial Sequence
  chemically synthesized
ccagaggtaagtggaatactga

SEQ ID NO: 1405016 - DNA, 22 bp, Artificial Sequence
  chemically synthesized
tcccagaggtaagtggaatact

SEQ ID NO: 1405017 - DNA, 22 bp, Artificial Sequence
  chemically synthesized
gatgtcagtattccacttacct

SEQ ID NO: 1405018 - DNA, 22 bp, Artificial Sequence
  chemically synthesized
gtcaatactctcccagaggtaa

SEQ ID NO: 1405019 - DNA, 22 bp, Artificial Sequence
  chemically synthesized
ctagtcaatactctcccagagg

SEQ ID NO: 1405020 - DNA, 22 bp, Artificial Sequence
  chemically synthesized
cctagtcaatactctcccagag

SEQ ID NO: 1405021 - DNA, 22 bp, Artificial Sequence
  chemically synthesized
cacttacctctgggagagtatt

SEQ ID NO: 1405022 - DNA, 22 bp, Artificial Sequence
  chemically synthesized
ccacttcctagtcaatactctc

SEQ ID NO: 1405023 - DNA, 22 bp, Artificial Sequence
  chemically synthesized
accacttcctagtcaatactct

SEQ ID NO: 1405024 - DNA, 22 bp, Artificial Sequence
  chemically synthesized
acctctgggagagtattgacta

SEQ ID NO: 1405025 - DNA, 22 bp, Artificial Sequence
  chemically synthesized
cctctgggagagtattgactag

SEQ ID NO: 1405026 - DNA, 22 bp, Artificial Sequence
  chemically synthesized
tcttaccacttcctagtcaata

SEQ ID NO: 1405027 - DNA, 22 bp, Artificial Sequence
  chemically synthesized
gtcttaccacttcctagtcaat

SEQ ID NO: 1405028 - DNA, 22 bp, Artificial Sequence
  chemically synthesized
tgtcttaccacttcctagtcaa

SEQ ID NO: 1405029 - DNA, 22 bp, Artificial Sequence
  chemically synthesized
tgggagagtattgactaggaag

SEQ ID NO: 1405030 - DNA, 22 bp, Artificial Sequence
  chemically synthesized
ggagagtattgactaggaagtg

SEQ ID NO: 1405031 - DNA, 22 bp, Artificial Sequence
  chemically synthesized
actaggaagtggtaagacaaag

SEQ ID NO: 1405032 - DNA, 22 bp, Artificial Sequence
  chemically synthesized
ccagcatccaaaaactttgtct

SEQ ID NO: 1405033 - DNA, 22 bp, Artificial Sequence
  chemically synthesized
ggaagtggtaagacaaagtttt

SEQ ID NO: 1405034 - DNA, 22 bp, Artificial Sequence
  chemically synthesized
aaggcaagaaaagaatattacc

SEQ ID NO: 1405035 - DNA, 22 bp, Artificial Sequence
  chemically synthesized
ttggatgctggtaatattcttt

SEQ ID NO: 1405036 - DNA, 22 bp, Artificial Sequence
  chemically synthesized
ctcaaggcaagaaaagaatatt

SEQ ID NO: 1405037 - DNA, 22 bp, Artificial Sequence
  chemically synthesized
tggatgctggtaatattctttt

SEQ ID NO: 1405038 - DNA, 22 bp, Artificial Sequence
  chemically synthesized
ggatgctggtaatattcttttc

SEQ ID NO: 1405039 - DNA, 22 bp, Artificial Sequence
  chemically synthesized
gatgctggtaatattcttttct

SEQ ID NO: 1405040 - DNA, 22 bp, Artificial Sequence
  chemically synthesized
gtaatattcttttcttgccttg

SEQ ID NO: 1405041 - DNA, 22 bp, Artificial Sequence
  chemically synthesized
ggcacaccccagtaattactca

SEQ ID NO: 1405042 - DNA, 22 bp, Artificial Sequence
  chemically synthesized
ttttcttgccttgagtaattac

SEQ ID NO: 1405043 - DNA, 22 bp, Artificial Sequence
  chemically synthesized
ttcttgccttgagtaattactg

SEQ ID NO: 1405044 - DNA, 22 bp, Artificial Sequence
  chemically synthesized
tcttgccttgagtaattactgg

SEQ ID NO: 1405045 - DNA, 22 bp, Artificial Sequence
  chemically synthesized
cttgccttgagtaattactggg

SEQ ID NO: 1405046 - DNA, 22 bp, Artificial Sequence
  chemically synthesized
ttgccttgagtaattactgggg

SEQ ID NO: 1405047 - DNA, 22 bp, Artificial Sequence
  chemically synthesized
gccttgagtaattactggggtg

SEQ ID NO: 1405048 - DNA, 22 bp, Artificial Sequence
  chemically synthesized
acagattgggcacaccccagta

SEQ ID NO: 1405049 - DNA, 22 bp, Artificial Sequence
  chemically synthesized
ccttgagtaattactggggtgt

SEQ ID NO: 1405050 - DNA, 22 bp, Artificial Sequence
  chemically synthesized
cacagattgggcacaccccagt

SEQ ID NO: 1405051 - DNA, 22 bp, Artificial Sequence
  chemically synthesized
tcacagattgggcacaccccag

SEQ ID NO: 1405052 - DNA, 22 bp, Artificial Sequence
  chemically synthesized
gagtaattactggggtgtgccc

SEQ ID NO: 1405053 - DNA, 22 bp, Artificial Sequence
  chemically synthesized
agtaattactggggtgtgccca

SEQ ID NO: 1405054 - DNA, 22 bp, Artificial Sequence
  chemically synthesized
atgaattttcacagattgggca

SEQ ID NO: 1405055 - DNA, 22 bp, Artificial Sequence
  chemically synthesized
catgaattttcacagattgggc

SEQ ID NO: 1405056 - DNA, 22 bp, Artificial Sequence
  chemically synthesized
ctggggtgtgcccaatctgtga

SEQ ID NO: 1405057 - DNA, 22 bp, Artificial Sequence
  chemically synthesized
gggtgtgcccaatctgtgaaaa

SEQ ID NO: 1405058 - DNA, 22 bp, Artificial Sequence
  chemically synthesized
tgaaaattcatgaagctggaca

SEQ ID NO: 1405059 - DNA, 22 bp, Artificial Sequence
  chemically synthesized
acaaatcaataggtgtccagct

SEQ ID NO: 1405060 - DNA, 22 bp, Artificial Sequence
  chemically synthesized
atgaagctggacacctattgat

SEQ ID NO: 1405061 - DNA, 22 bp, Artificial Sequence
  chemically synthesized
gacacctattgatttgtgaact

SEQ ID NO: 1405062 - DNA, 22 bp, Artificial Sequence
  chemically synthesized
taacacgaatatataaaagttc

SEQ ID NO: 1405063 - DNA, 22 bp, Artificial Sequence
  chemically synthesized
ttgatttgtgaacttttatata

SEQ ID NO: 1405064 - DNA, 22 bp, Artificial Sequence
  chemically synthesized
aactataacacgaatatataaa

SEQ ID NO: 1405065 - DNA, 22 bp, Artificial Sequence
  chemically synthesized
atttgtgaacttttatatattc

SEQ ID NO: 1405066 - DNA, 22 bp, Artificial Sequence
  chemically synthesized
ctgaactataacacgaatatat

SEQ ID NO: 1405067 - DNA, 22 bp, Artificial Sequence
  chemically synthesized
actgaactataacacgaatata

SEQ ID NO: 1405068 - DNA, 22 bp, Artificial Sequence
  chemically synthesized
gtgaacttttatatattcgtgt

SEQ ID NO: 1405069 - DNA, 22 bp, Artificial Sequence
  chemically synthesized
tactgaactataacacgaatat

SEQ ID NO: 1405070 - DNA, 22 bp, Artificial Sequence
  chemically synthesized
tgaacttttatatattcgtgtt

SEQ ID NO: 1405071 - DNA, 22 bp, Artificial Sequence
  chemically synthesized
ttatatattcgtgttatagttc

SEQ ID NO: 1405072 - DNA, 22 bp, Artificial Sequence
  chemically synthesized
aaacattttactgaactataac

SEQ ID NO: 1405073 - DNA, 22 bp, Artificial Sequence
  chemically synthesized
tatatattcgtgttatagttca

SEQ ID NO: 1405074 - DNA, 22 bp, Artificial Sequence
  chemically synthesized
aaaacattttactgaactataa

SEQ ID NO: 1405075 - DNA, 22 bp, Artificial Sequence
  chemically synthesized
atatattcgtgttatagttcag

SEQ ID NO: 1405076 - DNA, 22 bp, Artificial Sequence
  chemically synthesized
taaaacattttactgaactata

SEQ ID NO: 1405077 - DNA, 22 bp, Artificial Sequence
  chemically synthesized
tatattcgtgttatagttcagt

SEQ ID NO: 1405078 - DNA, 22 bp, Artificial Sequence
  chemically synthesized
ttaaaacattttactgaactat

SEQ ID NO: 1405079 - DNA, 22 bp, Artificial Sequence
  chemically synthesized
atttttaaaacattttactgaa

SEQ ID NO: 1405080 - DNA, 22 bp, Artificial Sequence
  chemically synthesized
gatttttaaaacattttactga

SEQ ID NO: 1405081 - DNA, 22 bp, Artificial Sequence
  chemically synthesized
gtgttatagttcagtaaaatgt

SEQ ID NO: 1405082 - DNA, 22 bp, Artificial Sequence
  chemically synthesized
cttgatttttaaaacattttac

SEQ ID NO: 1405083 - DNA, 22 bp, Artificial Sequence
  chemically synthesized
tagttcagtaaaatgttttaaa

SEQ ID NO: 1405084 - DNA, 22 bp, Artificial Sequence
  chemically synthesized
tcctccttgatttttaaaacat

SEQ ID NO: 1405085 - DNA, 22 bp, Artificial Sequence
  chemically synthesized
tgtcctccttgatttttaaaac

SEQ ID NO: 1405086 - DNA, 22 bp, Artificial Sequence
  chemically synthesized
ctgtcctccttgatttttaaaa

SEQ ID NO: 1405087 - DNA, 22 bp, Artificial Sequence
  chemically synthesized
agtaaaatgttttaaaaatcaa

SEQ ID NO: 1405088 - DNA, 22 bp, Artificial Sequence
  chemically synthesized
aggaaagtatttctgtcctcct

SEQ ID NO: 1405089 - DNA, 22 bp, Artificial Sequence
  chemically synthesized
taaaaatcaaggaggacagaaa

SEQ ID NO: 1405090 - DNA, 22 bp, Artificial Sequence
  chemically synthesized
aaaaatcaaggaggacagaaat

SEQ ID NO: 1405091 - DNA, 22 bp, Artificial Sequence
  chemically synthesized
aaaatcaaggaggacagaaata

SEQ ID NO: 1405092 - DNA, 22 bp, Artificial Sequence
  chemically synthesized
tagattaaggaaagtatttctg

SEQ ID NO: 1405093 - DNA, 22 bp, Artificial Sequence
  chemically synthesized
atagattaaggaaagtatttct

SEQ ID NO: 1405094 - DNA, 22 bp, Artificial Sequence
  chemically synthesized
tatagattaaggaaagtatttc

SEQ ID NO: 1405095 - DNA, 22 bp, Artificial Sequence
  chemically synthesized
cctttatagattaaggaaagta

SEQ ID NO: 1405096 - DNA, 22 bp, Artificial Sequence
  chemically synthesized
ccctttatagattaaggaaagt

SEQ ID NO: 1405097 - DNA, 22 bp, Artificial Sequence
  chemically synthesized
gtaatttccctttatagattaa

SEQ ID NO: 1405098 - DNA, 22 bp, Artificial Sequence
  chemically synthesized
attagtaatttccctttataga

SEQ ID NO: 1405099 - DNA, 22 bp, Artificial Sequence
  chemically synthesized
tccttaatctataaagggaaat

SEQ ID NO: 1405100 - DNA, 22 bp, Artificial Sequence
  chemically synthesized
ccttaatctataaagggaaatt

SEQ ID NO: 1405101 - DNA, 22 bp, Artificial Sequence
  chemically synthesized
cttaatctataaagggaaatta

SEQ ID NO: 1405102 - DNA, 22 bp, Artificial Sequence
  chemically synthesized
ccaacattcattagtaatttcc

SEQ ID NO: 1405103 - DNA, 22 bp, Artificial Sequence
  chemically synthesized
aatctataaagggaaattacta

SEQ ID NO: 1405104 - DNA, 22 bp, Artificial Sequence
  chemically synthesized
atctataaagggaaattactaa

SEQ ID NO: 1405105 - DNA, 22 bp, Artificial Sequence
  chemically synthesized
ctcccaacattcattagtaatt

SEQ ID NO: 1405106 - DNA, 22 bp, Artificial Sequence
  chemically synthesized
taaagggaaattactaatgaat

SEQ ID NO: 1405107 - DNA, 22 bp, Artificial Sequence
  chemically synthesized
ctaatgaatgttgggaggaatt

SEQ ID NO: 1405108 - DNA, 22 bp, Artificial Sequence
  chemically synthesized
aaggcaaagaaaaattcctccc

SEQ ID NO: 1405109 - DNA, 22 bp, Artificial Sequence
  chemically synthesized
atgaatgttgggaggaattttt

SEQ ID NO: 1405110 - DNA, 22 bp, Artificial Sequence
  chemically synthesized
ggaggaatttttctttgccttt

SEQ ID NO: 1405111 - DNA, 22 bp, Artificial Sequence
  chemically synthesized
gatatataggctaaaggcaaag

SEQ ID NO: 1405112 - DNA, 22 bp, Artificial Sequence
  chemically synthesized
agatatataggctaaaggcaaa

SEQ ID NO: 1405113 - DNA, 22 bp, Artificial Sequence
  chemically synthesized
ttctttgcctttagcctatata

SEQ ID NO: 1405114 - DNA, 22 bp, Artificial Sequence
  chemically synthesized
aagtaacttagatatataggct

SEQ ID NO: 1405115 - DNA, 22 bp, Artificial Sequence
  chemically synthesized
tctttgcctttagcctatatat

SEQ ID NO: 1405116 - DNA, 22 bp, Artificial Sequence
  chemically synthesized
ctttgcctttagcctatatatc

SEQ ID NO: 1405117 - DNA, 22 bp, Artificial Sequence
  chemically synthesized
tttgcctttagcctatatatct

SEQ ID NO: 1405118 - DNA, 22 bp, Artificial Sequence
  chemically synthesized
gctgaagtaacttagatatata

SEQ ID NO: 1405119 - DNA, 22 bp, Artificial Sequence
  chemically synthesized
tgcctttagcctatatatctaa

SEQ ID NO: 1405120 - DNA, 22 bp, Artificial Sequence
  chemically synthesized
gcctttagcctatatatctaag

SEQ ID NO: 1405121 - DNA, 22 bp, Artificial Sequence
  chemically synthesized
cctttagcctatatatctaagt

SEQ ID NO: 1405122 - DNA, 22 bp, Artificial Sequence
  chemically synthesized
actcgctgaagtaacttagata

SEQ ID NO: 1405123 - DNA, 22 bp, Artificial Sequence
  chemically synthesized
tgactcgctgaagtaacttaga

SEQ ID NO: 1405124 - DNA, 22 bp, Artificial Sequence
  chemically synthesized
tagcctatatatctaagttact

SEQ ID NO: 1405125 - DNA, 22 bp, Artificial Sequence
  chemically synthesized
agcctatatatctaagttactt

SEQ ID NO: 1405126 - DNA, 22 bp, Artificial Sequence
  chemically synthesized
gcctatatatctaagttacttc

SEQ ID NO: 1405127 - DNA, 22 bp, Artificial Sequence
  chemically synthesized
tatctctgactcgctgaagtaa

SEQ ID NO: 1405128 - DNA, 22 bp, Artificial Sequence
  chemically synthesized
atatctctgactcgctgaagta

SEQ ID NO: 1405129 - DNA, 22 bp, Artificial Sequence
  chemically synthesized
tatatctaagttacttcagcga

SEQ ID NO: 1405130 - DNA, 22 bp, Artificial Sequence
  chemically synthesized
tttatatctctgactcgctgaa

SEQ ID NO: 1405131 - DNA, 22 bp, Artificial Sequence
  chemically synthesized
agttacttcagcgagtcagaga

SEQ ID NO: 1405132 - DNA, 22 bp, Artificial Sequence
  chemically synthesized
tatatctatttatatctctgac

SEQ ID NO: 1405133 - DNA, 22 bp, Artificial Sequence
  chemically synthesized
cttcagcgagtcagagatataa

SEQ ID NO: 1405134 - DNA, 22 bp, Artificial Sequence
  chemically synthesized
tctatatatctatttatatctc

SEQ ID NO: 1405135 - DNA, 22 bp, Artificial Sequence
  chemically synthesized
atctatatatctatttatatct

SEQ ID NO: 1405136 - DNA, 22 bp, Artificial Sequence
  chemically synthesized
cagcgagtcagagatataaata

SEQ ID NO: 1405137 - DNA, 22 bp, Artificial Sequence
  chemically synthesized
agcgagtcagagatataaatag

SEQ ID NO: 1405138 - DNA, 22 bp, Artificial Sequence
  chemically synthesized
acatatatagatatgcatatat

SEQ ID NO: 1405139 - DNA, 22 bp, Artificial Sequence
  chemically synthesized
tgacatatatagatatgcatat

SEQ ID NO: 1405140 - DNA, 22 bp, Artificial Sequence
  chemically synthesized
ctgacatatatagatatgcata

SEQ ID NO: 1405141 - DNA, 22 bp, Artificial Sequence
  chemically synthesized
ttctgacatatatagatatgca

SEQ ID NO: 1405142 - DNA, 22 bp, Artificial Sequence
  chemically synthesized
cttctgacatatatagatatgc

SEQ ID NO: 1405143 - DNA, 22 bp, Artificial Sequence
  chemically synthesized
ccttcttctgacatatatagat

SEQ ID NO: 1405144 - DNA, 22 bp, Artificial Sequence
  chemically synthesized
tcccttcttctgacatatatag

SEQ ID NO: 1405145 - DNA, 22 bp, Artificial Sequence
  chemically synthesized
tctcccttcttctgacatatat

SEQ ID NO: 1405146 - DNA, 22 bp, Artificial Sequence
  chemically synthesized
tctctcccttcttctgacatat

SEQ ID NO: 1405147 - DNA, 22 bp, Artificial Sequence
  chemically synthesized
ctctctcccttcttctgacata

SEQ ID NO: 1405148 - DNA, 22 bp, Artificial Sequence
  chemically synthesized
tctctctcccttcttctgacat

SEQ ID NO: 1405149 - DNA, 22 bp, Artificial Sequence
  chemically synthesized
tttctctctcccttcttctgac

SEQ ID NO: 1405150 - DNA, 22 bp, Artificial Sequence
  chemically synthesized
ctctttctctctcccttcttct

SEQ ID NO: 1405151 - DNA, 22 bp, Artificial Sequence
  chemically synthesized
tcctctttctctctcccttctt

SEQ ID NO: 1405152 - DNA, 22 bp, Artificial Sequence
  chemically synthesized
tatatgtcagaagaagggagag

SEQ ID NO: 1405153 - DNA, 22 bp, Artificial Sequence
  chemically synthesized
tctcctctttctctctcccttc

SEQ ID NO: 1405154 - DNA, 22 bp, Artificial Sequence
  chemically synthesized
tctctcctctttctctctccct

SEQ ID NO: 1405155 - DNA, 22 bp, Artificial Sequence
  chemically synthesized
tctctctcctctttctctctcc

SEQ ID NO: 1405156 - DNA, 22 bp, Artificial Sequence
  chemically synthesized
tcgaaaaaagtctctctctctc

SEQ ID NO: 1405157 - DNA, 22 bp, Artificial Sequence
  chemically synthesized
attatcgaaaaaagtctctctc

SEQ ID NO: 1405158 - DNA, 22 bp, Artificial Sequence
  chemically synthesized
aattatcgaaaaaagtctctct

SEQ ID NO: 1405159 - DNA, 22 bp, Artificial Sequence
  chemically synthesized
aagaatttaattatcgaaaaaa

SEQ ID NO: 1405160 - DNA, 22 bp, Artificial Sequence
  chemically synthesized
taaagaatttaattatcgaaaa

SEQ ID NO: 1405161 - DNA, 22 bp, Artificial Sequence
  chemically synthesized
ctaaagaatttaattatcgaaa

SEQ ID NO: 1405162 - DNA, 22 bp, Artificial Sequence
  chemically synthesized
tctaaagaatttaattatcgaa

SEQ ID NO: 1405163 - DNA, 22 bp, Artificial Sequence
  chemically synthesized
ttttcgataattaaattcttta

SEQ ID NO: 1405164 - DNA, 22 bp, Artificial Sequence
  chemically synthesized
tttcgataattaaattctttag

SEQ ID NO: 1405165 - DNA, 22 bp, Artificial Sequence
  chemically synthesized
ttcgataattaaattctttaga

SEQ ID NO: 1405166 - DNA, 22 bp, Artificial Sequence
  chemically synthesized
tcgataattaaattctttagaa

SEQ ID NO: 1405167 - DNA, 22 bp, Artificial Sequence
  chemically synthesized
aagcagtacattttctaaagaa

SEQ ID NO: 1405168 - DNA, 22 bp, Artificial Sequence
  chemically synthesized
cgataattaaattctttagaaa

SEQ ID NO: 1405169 - DNA, 22 bp, Artificial Sequence
  chemically synthesized
gataattaaattctttagaaaa

SEQ ID NO: 1405170 - DNA, 22 bp, Artificial Sequence
  chemically synthesized
tcaagcagtacattttctaaag

SEQ ID NO: 1405171 - DNA, 22 bp, Artificial Sequence
  chemically synthesized
tctcaagcagtacattttctaa

SEQ ID NO: 1405172 - DNA, 22 bp, Artificial Sequence
  chemically synthesized
tctctcaagcagtacattttct

SEQ ID NO: 1405173 - DNA, 22 bp, Artificial Sequence
  chemically synthesized
aattctttagaaaatgtactgc

SEQ ID NO: 1405174 - DNA, 22 bp, Artificial Sequence
  chemically synthesized
tttagaaaatgtactgcttgag

SEQ ID NO: 1405175 - DNA, 22 bp, Artificial Sequence
  chemically synthesized
tagaaaatgtactgcttgagag

SEQ ID NO: 1405176 - DNA, 22 bp, Artificial Sequence
  chemically synthesized
agaaaatgtactgcttgagaga

SEQ ID NO: 1405177 - DNA, 22 bp, Artificial Sequence
  chemically synthesized
gaaaatgtactgcttgagagag

SEQ ID NO: 1405178 - DNA, 22 bp, Artificial Sequence
  chemically synthesized
cttgagagagaatgactttctg

SEQ ID NO: 1405179 - DNA, 22 bp, Artificial Sequence
  chemically synthesized
gagagagaatgactttctggat

SEQ ID NO: 1405180 - DNA, 22 bp, Artificial Sequence
  chemically synthesized
aagaatcgaatcatccagaaag

SEQ ID NO: 1405181 - DNA, 22 bp, Artificial Sequence
  chemically synthesized
agagagaatgactttctggatg

SEQ ID NO: 1405182 - DNA, 22 bp, Artificial Sequence
  chemically synthesized
tgaagaatcgaatcatccagaa

SEQ ID NO: 1405183 - DNA, 22 bp, Artificial Sequence
  chemically synthesized
ctgaagaatcgaatcatccaga

SEQ ID NO: 1405184 - DNA, 22 bp, Artificial Sequence
  chemically synthesized
tctgaagaatcgaatcatccag

SEQ ID NO: 1405185 - DNA, 22 bp, Artificial Sequence
  chemically synthesized
tctggatgattcgattcttcag

SEQ ID NO: 1405186 - DNA, 22 bp, Artificial Sequence
  chemically synthesized
ctggatgattcgattcttcaga

SEQ ID NO: 1405187 - DNA, 22 bp, Artificial Sequence
  chemically synthesized
tggatgattcgattcttcagaa

SEQ ID NO: 1405188 - DNA, 22 bp, Artificial Sequence
  chemically synthesized
gatgattcgattcttcagaaaa

SEQ ID NO: 1405189 - DNA, 22 bp, Artificial Sequence
  chemically synthesized
gattcttcagaaaatatcttgt

SEQ ID NO: 1405190 - DNA, 22 bp, Artificial Sequence
  chemically synthesized
aaaagagacaggtaaacaagat

SEQ ID NO: 1405191 - DNA, 22 bp, Artificial Sequence
  chemically synthesized
ttcagaaaatatcttgtttacc

SEQ ID NO: 1405192 - DNA, 22 bp, Artificial Sequence
  chemically synthesized
cagaaaatatcttgtttacctg

SEQ ID NO: 1405193 - DNA, 22 bp, Artificial Sequence
  chemically synthesized
agaaaatatcttgtttacctgt

SEQ ID NO: 1405194 - DNA, 22 bp, Artificial Sequence
  chemically synthesized
ggaaattaaaaagagacaggta

SEQ ID NO: 1405195 - DNA, 22 bp, Artificial Sequence
  chemically synthesized
ctaggaaattaaaaagagacag

SEQ ID NO: 1405196 - DNA, 22 bp, Artificial Sequence
  chemically synthesized
ctcctaggaaattaaaaagaga

SEQ ID NO: 1405197 - DNA, 22 bp, Artificial Sequence
  chemically synthesized
gtttacctgtctctttttaatt

SEQ ID NO: 1405198 - DNA, 22 bp, Artificial Sequence
  chemically synthesized
tttacctgtctctttttaattt

SEQ ID NO: 1405199 - DNA, 22 bp, Artificial Sequence
  chemically synthesized
acctgtctctttttaatttcct

SEQ ID NO: 1405200 - DNA, 22 bp, Artificial Sequence
  chemically synthesized
cctgtctctttttaatttccta

SEQ ID NO: 1405201 - DNA, 22 bp, Artificial Sequence
  chemically synthesized
acacccaactcctcctaggaaa

SEQ ID NO: 1405202 - DNA, 22 bp, Artificial Sequence
  chemically synthesized
tctctttttaatttcctaggag

SEQ ID NO: 1405203 - DNA, 22 bp, Artificial Sequence
  chemically synthesized
tttttaatttcctaggaggagt

SEQ ID NO: 1405204 - DNA, 22 bp, Artificial Sequence
  chemically synthesized
tttaatttcctaggaggagttg

SEQ ID NO: 1405205 - DNA, 22 bp, Artificial Sequence
  chemically synthesized
cagcctcacacccaactcctcc

SEQ ID NO: 1405206 - DNA, 22 bp, Artificial Sequence
  chemically synthesized
ttaatttcctaggaggagttgg

SEQ ID NO: 1405207 - DNA, 22 bp, Artificial Sequence
  chemically synthesized
taatttcctaggaggagttggg

SEQ ID NO: 1405208 - DNA, 22 bp, Artificial Sequence
  chemically synthesized
aatttcctaggaggagttgggt

SEQ ID NO: 1405209 - DNA, 22 bp, Artificial Sequence
  chemically synthesized
atttcctaggaggagttgggtg

SEQ ID NO: 1405210 - DNA, 22 bp, Artificial Sequence
  chemically synthesized
atctccagcctcacacccaact

SEQ ID NO: 1405211 - DNA, 22 bp, Artificial Sequence
  chemically synthesized
cctaggaggagttgggtgtgag

SEQ ID NO: 1405212 - DNA, 22 bp, Artificial Sequence
  chemically synthesized
ctaggaggagttgggtgtgagg

SEQ ID NO: 1405213 - DNA, 22 bp, Artificial Sequence
  chemically synthesized
attgatctccagcctcacaccc

SEQ ID NO: 1405214 - DNA, 22 bp, Artificial Sequence
  chemically synthesized
aattgatctccagcctcacacc

SEQ ID NO: 1405215 - DNA, 22 bp, Artificial Sequence
  chemically synthesized
ggaggagttgggtgtgaggctg

SEQ ID NO: 1405216 - DNA, 22 bp, Artificial Sequence
  chemically synthesized
caatttaattgatctccagcct

SEQ ID NO: 1405217 - DNA, 22 bp, Artificial Sequence
  chemically synthesized
ccaatttaattgatctccagcc

SEQ ID NO: 1405218 - DNA, 22 bp, Artificial Sequence
  chemically synthesized
ggtgtgaggctggagatcaatt

SEQ ID NO: 1405219 - DNA, 22 bp, Artificial Sequence
  chemically synthesized
aacatcttccaatttaattgat

SEQ ID NO: 1405220 - DNA, 22 bp, Artificial Sequence
  chemically synthesized
caacatcttccaatttaattga

SEQ ID NO: 1405221 - DNA, 22 bp, Artificial Sequence
  chemically synthesized
gagatcaattaaattggaagat

SEQ ID NO: 1405222 - DNA, 22 bp, Artificial Sequence
  chemically synthesized
tccaatttcaacatcttccaat

SEQ ID NO: 1405223 - DNA, 22 bp, Artificial Sequence
  chemically synthesized
atccaatttcaacatcttccaa

SEQ ID NO: 1405224 - DNA, 22 bp, Artificial Sequence
  chemically synthesized
tatccaatttcaacatcttcca

SEQ ID NO: 1405225 - DNA, 22 bp, Artificial Sequence
  chemically synthesized
aattggaagatgttgaaattgg

SEQ ID NO: 1405226 - DNA, 22 bp, Artificial Sequence
  chemically synthesized
gaagatgttgaaattggataaa

SEQ ID NO: 1405227 - DNA, 22 bp, Artificial Sequence
  chemically synthesized
gataatccgtaaggttttatcc

SEQ ID NO: 1405228 - DNA, 22 bp, Artificial Sequence
  chemically synthesized
tgttagataatccgtaaggttt

SEQ ID NO: 1405229 - DNA, 22 bp, Artificial Sequence
  chemically synthesized
aaattggataaaaccttacgga

SEQ ID NO: 1405230 - DNA, 22 bp, Artificial Sequence
  chemically synthesized
gataaaaccttacggattatct

SEQ ID NO: 1405231 - DNA, 22 bp, Artificial Sequence
  chemically synthesized
taacaataagaaattgtgttag

SEQ ID NO: 1405232 - DNA, 22 bp, Artificial Sequence
  chemically synthesized
acggattatctaacacaatttc

SEQ ID NO: 1405233 - DNA, 22 bp, Artificial Sequence
  chemically synthesized
cggattatctaacacaatttct

SEQ ID NO: 1405234 - DNA, 22 bp, Artificial Sequence
  chemically synthesized
tctaacacaatttcttattgtt

SEQ ID NO: 1405235 - DNA, 22 bp, Artificial Sequence
  chemically synthesized
ccaaataaacctgtaacaataa

SEQ ID NO: 1405236 - DNA, 22 bp, Artificial Sequence
  chemically synthesized
acacaatttcttattgttacag

SEQ ID NO: 1405237 - DNA, 22 bp, Artificial Sequence
  chemically synthesized
ttgccaaataaacctgtaacaa

SEQ ID NO: 1405238 - DNA, 22 bp, Artificial Sequence
  chemically synthesized
cttattgttacaggtttatttg

SEQ ID NO: 1405239 - DNA, 22 bp, Artificial Sequence
  chemically synthesized
ttattgttacaggtttatttgg

SEQ ID NO: 1405240 - DNA, 22 bp, Artificial Sequence
  chemically synthesized
attgttacaggtttatttggca

SEQ ID NO: 1405241 - DNA, 22 bp, Artificial Sequence
  chemically synthesized
ttgttacaggtttatttggcaa

SEQ ID NO: 1405242 - DNA, 22 bp, Artificial Sequence
  chemically synthesized
ttacaggtttatttggcaatag

SEQ ID NO: 1405243 - DNA, 22 bp, Artificial Sequence
  chemically synthesized
agatagaatagatctattgcca

SEQ ID NO: 1405244 - DNA, 22 bp, Artificial Sequence
  chemically synthesized
caggtttatttggcaatagatc

SEQ ID NO: 1405245 - DNA, 22 bp, Artificial Sequence
  chemically synthesized
atttggcaatagatctattcta

SEQ ID NO: 1405246 - DNA, 22 bp, Artificial Sequence
  chemically synthesized
tttggcaatagatctattctat

SEQ ID NO: 1405247 - DNA, 22 bp, Artificial Sequence
  chemically synthesized
ggcaatagatctattctatctg

SEQ ID NO: 1405248 - DNA, 22 bp, Artificial Sequence
  chemically synthesized
gcaatagatctattctatctga

SEQ ID NO: 1405249 - DNA, 22 bp, Artificial Sequence
  chemically synthesized
aaaggataacatctcagataga

SEQ ID NO: 1405250 - DNA, 22 bp, Artificial Sequence
  chemically synthesized
ttctatctgagatgttatcctt

SEQ ID NO: 1405251 - DNA, 22 bp, Artificial Sequence
  chemically synthesized
caaaggagggctgaaaggataa

SEQ ID NO: 1405252 - DNA, 22 bp, Artificial Sequence
  chemically synthesized
tatctgagatgttatcctttca

SEQ ID NO: 1405253 - DNA, 22 bp, Artificial Sequence
  chemically synthesized
tctgagatgttatcctttcagc

SEQ ID NO: 1405254 - DNA, 22 bp, Artificial Sequence
  chemically synthesized
agatgttatcctttcagccctc

SEQ ID NO: 1405255 - DNA, 22 bp, Artificial Sequence
  chemically synthesized
agaggttacaaaggagggctga

SEQ ID NO: 1405256 - DNA, 22 bp, Artificial Sequence
  chemically synthesized
tcctttcagccctcctttgtaa

SEQ ID NO: 1405257 - DNA, 22 bp, Artificial Sequence
  chemically synthesized
tcagccctcctttgtaacctct

SEQ ID NO: 1405258 - DNA, 22 bp, Artificial Sequence
  chemically synthesized
cagccctcctttgtaacctctg

SEQ ID NO: 1405259 - DNA, 22 bp, Artificial Sequence
  chemically synthesized
agccctcctttgtaacctctga

SEQ ID NO: 1405260 - DNA, 22 bp, Artificial Sequence
  chemically synthesized
atcacagaatcagacctcagag

SEQ ID NO: 1405261 - DNA, 22 bp, Artificial Sequence
  chemically synthesized
ctttgtaacctctgaggtctga

SEQ ID NO: 1405262 - DNA, 22 bp, Artificial Sequence
  chemically synthesized
aattaatcacagaatcagacct

SEQ ID NO: 1405263 - DNA, 22 bp, Artificial Sequence
  chemically synthesized
tgtaacctctgaggtctgattc

SEQ ID NO: 1405264 - DNA, 22 bp, Artificial Sequence
  chemically synthesized
gtaacctctgaggtctgattct

SEQ ID NO: 1405265 - DNA, 22 bp, Artificial Sequence
  chemically synthesized
taacctctgaggtctgattctg

SEQ ID NO: 1405266 - DNA, 22 bp, Artificial Sequence
  chemically synthesized
tgaggtctgattctgtgattaa

SEQ ID NO: 1405267 - DNA, 22 bp, Artificial Sequence
  chemically synthesized
aggtctgattctgtgattaatt

SEQ ID NO: 1405268 - DNA, 22 bp, Artificial Sequence
  chemically synthesized
atgtataaagttaaattaatca

SEQ ID NO: 1405269 - DNA, 22 bp, Artificial Sequence
  chemically synthesized
actcatgtataaagttaaatta

SEQ ID NO: 1405270 - DNA, 22 bp, Artificial Sequence
  chemically synthesized
cactcatgtataaagttaaatt

SEQ ID NO: 1405271 - DNA, 22 bp, Artificial Sequence
  chemically synthesized
attctgtgattaatttaacttt

SEQ ID NO: 1405272 - DNA, 22 bp, Artificial Sequence
  chemically synthesized
tgtgattaatttaactttatac

SEQ ID NO: 1405273 - DNA, 22 bp, Artificial Sequence
  chemically synthesized
tgattaatttaactttatacat

SEQ ID NO: 1405274 - DNA, 22 bp, Artificial Sequence
  chemically synthesized
aaaatgtttcactcatgtataa

SEQ ID NO: 1405275 - DNA, 22 bp, Artificial Sequence
  chemically synthesized
atttaactttatacatgagtga

SEQ ID NO: 1405276 - DNA, 22 bp, Artificial Sequence
  chemically synthesized
cctgaaaatgtttcactcatgt

SEQ ID NO: 1405277 - DNA, 22 bp, Artificial Sequence
  chemically synthesized
aactttatacatgagtgaaaca

SEQ ID NO: 1405278 - DNA, 22 bp, Artificial Sequence
  chemically synthesized
actttatacatgagtgaaacat

SEQ ID NO: 1405279 - DNA, 22 bp, Artificial Sequence
  chemically synthesized
gaagctacctgaaaatgtttca

SEQ ID NO: 1405280 - DNA, 22 bp, Artificial Sequence
  chemically synthesized
tatacatgagtgaaacattttc

SEQ ID NO: 1405281 - DNA, 22 bp, Artificial Sequence
  chemically synthesized
atacatgagtgaaacattttca

SEQ ID NO: 1405282 - DNA, 22 bp, Artificial Sequence
  chemically synthesized
tacatgagtgaaacattttcag

SEQ ID NO: 1405283 - DNA, 22 bp, Artificial Sequence
  chemically synthesized
attagaagctacctgaaaatgt

SEQ ID NO: 1405284 - DNA, 22 bp, Artificial Sequence
  chemically synthesized
aattagaagctacctgaaaatg

SEQ ID NO: 1405285 - DNA, 22 bp, Artificial Sequence
  chemically synthesized
taattagaagctacctgaaaat

SEQ ID NO: 1405286 - DNA, 22 bp, Artificial Sequence
  chemically synthesized
tttaattagaagctacctgaaa

SEQ ID NO: 1405287 - DNA, 22 bp, Artificial Sequence
  chemically synthesized
acactctttaattagaagctac

SEQ ID NO: 1405288 - DNA, 22 bp, Artificial Sequence
  chemically synthesized
tcaggtagcttctaattaaaga

SEQ ID NO: 1405289 - DNA, 22 bp, Artificial Sequence
  chemically synthesized
aatgtctaacactctttaatta

SEQ ID NO: 1405290 - DNA, 22 bp, Artificial Sequence
  chemically synthesized
caggtagcttctaattaaagag

SEQ ID NO: 1405291 - DNA, 22 bp, Artificial Sequence
  chemically synthesized
aggtagcttctaattaaagagt

SEQ ID NO: 1405292 - DNA, 22 bp, Artificial Sequence
  chemically synthesized
tctcaatgtctaacactcttta

SEQ ID NO: 1405293 - DNA, 22 bp, Artificial Sequence
  chemically synthesized
atctcaatgtctaacactcttt

SEQ ID NO: 1405294 - DNA, 22 bp, Artificial Sequence
  chemically synthesized
tatctcaatgtctaacactctt

SEQ ID NO: 1405295 - DNA, 22 bp, Artificial Sequence
  chemically synthesized
ctaattaaagagtgttagacat

SEQ ID NO: 1405296 - DNA, 22 bp, Artificial Sequence
  chemically synthesized
taattaaagagtgttagacatt

SEQ ID NO: 1405297 - DNA, 22 bp, Artificial Sequence
  chemically synthesized
attaaagagtgttagacattga

SEQ ID NO: 1405298 - DNA, 22 bp, Artificial Sequence
  chemically synthesized
tcatattttatctcaatgtcta

SEQ ID NO: 1405299 - DNA, 22 bp, Artificial Sequence
  chemically synthesized
gtcatattttatctcaatgtct

SEQ ID NO: 1405300 - DNA, 22 bp, Artificial Sequence
  chemically synthesized
aagagtgttagacattgagata

SEQ ID NO: 1405301 - DNA, 22 bp, Artificial Sequence
  chemically synthesized
gagaccttgtcatattttatct

SEQ ID NO: 1405302 - DNA, 22 bp, Artificial Sequence
  chemically synthesized
agagaccttgtcatattttatc

SEQ ID NO: 1405303 - DNA, 22 bp, Artificial Sequence
  chemically synthesized
tagagaccttgtcatattttat

SEQ ID NO: 1405304 - DNA, 22 bp, Artificial Sequence
  chemically synthesized
gacattgagataaaatatgaca

SEQ ID NO: 1405305 - DNA, 22 bp, Artificial Sequence
  chemically synthesized
tctttagagaccttgtcatatt

SEQ ID NO: 1405306 - DNA, 22 bp, Artificial Sequence
  chemically synthesized
tgctatctttagagaccttgtc

SEQ ID NO: 1405307 - DNA, 22 bp, Artificial Sequence
  chemically synthesized
agataaaatatgacaaggtctc

SEQ ID NO: 1405308 - DNA, 22 bp, Artificial Sequence
  chemically synthesized
ctatgctatctttagagacctt

SEQ ID NO: 1405309 - DNA, 22 bp, Artificial Sequence
  chemically synthesized
cctatgctatctttagagacct

SEQ ID NO: 1405310 - DNA, 22 bp, Artificial Sequence
  chemically synthesized
tcctatgctatctttagagacc

SEQ ID NO: 1405311 - DNA, 22 bp, Artificial Sequence
  chemically synthesized
ttcctatgctatctttagagac

SEQ ID NO: 1405312 - DNA, 22 bp, Artificial Sequence
  chemically synthesized
tttcctatgctatctttagaga

SEQ ID NO: 1405313 - DNA, 22 bp, Artificial Sequence
  chemically synthesized
gaaactttttcctatgctatct

SEQ ID NO: 1405314 - DNA, 22 bp, Artificial Sequence
  chemically synthesized
tccctggaaactttttcctatg

SEQ ID NO: 1405315 - DNA, 22 bp, Artificial Sequence
  chemically synthesized
taaagatagcataggaaaaagt

SEQ ID NO: 1405316 - DNA, 22 bp, Artificial Sequence
  chemically synthesized
aagatagcataggaaaaagttt

SEQ ID NO: 1405317 - DNA, 22 bp, Artificial Sequence
  chemically synthesized
tgtacgtctatccctggaaact

SEQ ID NO: 1405318 - DNA, 22 bp, Artificial Sequence
  chemically synthesized
atgtacgtctatccctggaaac

SEQ ID NO: 1405319 - DNA, 22 bp, Artificial Sequence
  chemically synthesized
gtagtttatgtacgtctatccc

SEQ ID NO: 1405320 - DNA, 22 bp, Artificial Sequence
  chemically synthesized
ccattggtagtttatgtacgtc

SEQ ID NO: 1405321 - DNA, 22 bp, Artificial Sequence
  chemically synthesized
ccagggatagacgtacataaac

SEQ ID NO: 1405322 - DNA, 22 bp, Artificial Sequence
  chemically synthesized
cagggatagacgtacataaact

SEQ ID NO: 1405323 - DNA, 22 bp, Artificial Sequence
  chemically synthesized
cctcccattggtagtttatgta

SEQ ID NO: 1405324 - DNA, 22 bp, Artificial Sequence
  chemically synthesized
aaaacagttacctcccattggt

SEQ ID NO: 1405325 - DNA, 22 bp, Artificial Sequence
  chemically synthesized
gaaaacagttacctcccattgg

SEQ ID NO: 1405326 - DNA, 22 bp, Artificial Sequence
  chemically synthesized
aggaggatttgaaaacagttac

SEQ ID NO: 1405327 - DNA, 22 bp, Artificial Sequence
  chemically synthesized
caggaggatttgaaaacagtta

SEQ ID NO: 1405328 - DNA, 22 bp, Artificial Sequence
  chemically synthesized
ccaatgggaggtaactgttttc

SEQ ID NO: 1405329 - DNA, 22 bp, Artificial Sequence
  chemically synthesized
tcaggaggatttgaaaacagtt

SEQ ID NO: 1405330 - DNA, 22 bp, Artificial Sequence
  chemically synthesized
ttttcaaatcctcctgaaagtt

SEQ ID NO: 1405331 - DNA, 22 bp, Artificial Sequence
  chemically synthesized
tcaaatcctcctgaaagtttgc

SEQ ID NO: 1405332 - DNA, 22 bp, Artificial Sequence
  chemically synthesized
caaatcctcctgaaagtttgca

SEQ ID NO: 1405333 - DNA, 22 bp, Artificial Sequence
  chemically synthesized
aaatcctcctgaaagtttgcat

SEQ ID NO: 1405334 - DNA, 22 bp, Artificial Sequence
  chemically synthesized
gcatgagcatgaccatgcaaac

SEQ ID NO: 1405335 - DNA, 22 bp, Artificial Sequence
  chemically synthesized
ctgaaagtttgcatggtcatgc

SEQ ID NO: 1405336 - DNA, 22 bp, Artificial Sequence
  chemically synthesized
aagctagcatgagcatgaccat

SEQ ID NO: 1405337 - DNA, 22 bp, Artificial Sequence
  chemically synthesized
aaagtttgcatggtcatgctca

SEQ ID NO: 1405338 - DNA, 22 bp, Artificial Sequence
  chemically synthesized
gcatggtcatgctcatgctagc

SEQ ID NO: 1405339 - DNA, 22 bp, Artificial Sequence
  chemically synthesized
aatatgattaaagctagcatga

SEQ ID NO: 1405340 - DNA, 22 bp, Artificial Sequence
  chemically synthesized
catggtcatgctcatgctagct

SEQ ID NO: 1405341 - DNA, 22 bp, Artificial Sequence
  chemically synthesized
atgctagctttaatcatattta

SEQ ID NO: 1405342 - DNA, 22 bp, Artificial Sequence
  chemically synthesized
catacaatgatattaaatatga

SEQ ID NO: 1405343 - DNA, 22 bp, Artificial Sequence
  chemically synthesized
gctttaatcatatttaatatca

SEQ ID NO: 1405344 - DNA, 22 bp, Artificial Sequence
  chemically synthesized
taatcatatttaatatcattgt

SEQ ID NO: 1405345 - DNA, 22 bp, Artificial Sequence
  chemically synthesized
aatcatatttaatatcattgta

SEQ ID NO: 1405346 - DNA, 22 bp, Artificial Sequence
  chemically synthesized
atcatatttaatatcattgtat

SEQ ID NO: 1405347 - DNA, 22 bp, Artificial Sequence
  chemically synthesized
aaagccagttgcatacaatgat

SEQ ID NO: 1405348 - DNA, 22 bp, Artificial Sequence
  chemically synthesized
gtctaaaagccagttgcataca

SEQ ID NO: 1405349 - DNA, 22 bp, Artificial Sequence
  chemically synthesized
aatatcattgtatgcaactggc

SEQ ID NO: 1405350 - DNA, 22 bp, Artificial Sequence
  chemically synthesized
atatcattgtatgcaactggct

SEQ ID NO: 1405351 - DNA, 22 bp, Artificial Sequence
  chemically synthesized
ggctggtctaaaagccagttgc

SEQ ID NO: 1405352 - DNA, 22 bp, Artificial Sequence
  chemically synthesized
tatgcaactggcttttagacca

SEQ ID NO: 1405353 - DNA, 22 bp, Artificial Sequence
  chemically synthesized
gaaggaaaatgtctaggctggt

SEQ ID NO: 1405354 - DNA, 22 bp, Artificial Sequence
  chemically synthesized
gcttttagaccagcctagacat

SEQ ID NO: 1405355 - DNA, 22 bp, Artificial Sequence
  chemically synthesized
ttagaccagcctagacattttc

SEQ ID NO: 1405356 - DNA, 22 bp, Artificial Sequence
  chemically synthesized
tagaccagcctagacattttcc

SEQ ID NO: 1405357 - DNA, 22 bp, Artificial Sequence
  chemically synthesized
agaccagcctagacattttcct

SEQ ID NO: 1405358 - DNA, 22 bp, Artificial Sequence
  chemically synthesized
gaccagcctagacattttcctt

SEQ ID NO: 1405359 - DNA, 22 bp, Artificial Sequence
  chemically synthesized
gaatcaaacctagaaggaaaat

SEQ ID NO: 1405360 - DNA, 22 bp, Artificial Sequence
  chemically synthesized
actggaatcaaacctagaagga

SEQ ID NO: 1405361 - DNA, 22 bp, Artificial Sequence
  chemically synthesized
cactggaatcaaacctagaagg

SEQ ID NO: 1405362 - DNA, 22 bp, Artificial Sequence
  chemically synthesized
gacattttccttctaggtttga

SEQ ID NO: 1405363 - DNA, 22 bp, Artificial Sequence
  chemically synthesized
atcttcactggaatcaaaccta

SEQ ID NO: 1405364 - DNA, 22 bp, Artificial Sequence
  chemically synthesized
ctcatcttcactggaatcaaac

SEQ ID NO: 1405365 - DNA, 22 bp, Artificial Sequence
  chemically synthesized
tccttctaggtttgattccagt

SEQ ID NO: 1405366 - DNA, 22 bp, Artificial Sequence
  chemically synthesized
ttgctcatcttcactggaatca

SEQ ID NO: 1405367 - DNA, 22 bp, Artificial Sequence
  chemically synthesized
ccttctaggtttgattccagtg

SEQ ID NO: 1405368 - DNA, 22 bp, Artificial Sequence
  chemically synthesized
cttctaggtttgattccagtga

SEQ ID NO: 1405369 - DNA, 22 bp, Artificial Sequence
  chemically synthesized
ctaggtttgattccagtgaaga

SEQ ID NO: 1405370 - DNA, 22 bp, Artificial Sequence
  chemically synthesized
taggtttgattccagtgaagat

SEQ ID NO: 1405371 - DNA, 22 bp, Artificial Sequence
  chemically synthesized
cacctgttgctcatcttcactg

SEQ ID NO: 1405372 - DNA, 22 bp, Artificial Sequence
  chemically synthesized
ccacctgttgctcatcttcact

SEQ ID NO: 1405373 - DNA, 22 bp, Artificial Sequence
  chemically synthesized
ggtttgattccagtgaagatga

SEQ ID NO: 1405374 - DNA, 22 bp, Artificial Sequence
  chemically synthesized
gattccagtgaagatgagcaac

SEQ ID NO: 1405375 - DNA, 22 bp, Artificial Sequence
  chemically synthesized
attccagtgaagatgagcaaca

SEQ ID NO: 1405376 - DNA, 22 bp, Artificial Sequence
  chemically synthesized
cagtgaagatgagcaacaggtg

SEQ ID NO: 1405377 - DNA, 22 bp, Artificial Sequence
  chemically synthesized
aaataaaaaggagcatgccttc

SEQ ID NO: 1405378 - DNA, 22 bp, Artificial Sequence
  chemically synthesized
gaaataaaaaggagcatgcctt

SEQ ID NO: 1405379 - DNA, 22 bp, Artificial Sequence
  chemically synthesized
aagtgtcacttgaaataaaaag

SEQ ID NO: 1405380 - DNA, 22 bp, Artificial Sequence
  chemically synthesized
gaagtgtcacttgaaataaaaa

SEQ ID NO: 1405381 - DNA, 22 bp, Artificial Sequence
  chemically synthesized
ctttttatttcaagtgacactt

SEQ ID NO: 1405382 - DNA, 22 bp, Artificial Sequence
  chemically synthesized
tttatttcaagtgacacttcaa

SEQ ID NO: 1405383 - DNA, 22 bp, Artificial Sequence
  chemically synthesized
ttatttcaagtgacacttcaaa

SEQ ID NO: 1405384 - DNA, 22 bp, Artificial Sequence
  chemically synthesized
tatttcaagtgacacttcaaat

SEQ ID NO: 1405385 - DNA, 22 bp, Artificial Sequence
  chemically synthesized
atttcaagtgacacttcaaata

SEQ ID NO: 1405386 - DNA, 22 bp, Artificial Sequence
  chemically synthesized
tttcaagtgacacttcaaatat

SEQ ID NO: 1405387 - DNA, 22 bp, Artificial Sequence
  chemically synthesized
caagtgacacttcaaatatgtc

SEQ ID NO: 1405388 - DNA, 22 bp, Artificial Sequence
  chemically synthesized
aagtgacacttcaaatatgtcg

SEQ ID NO: 1405389 - DNA, 22 bp, Artificial Sequence
  chemically synthesized
aaagtaaagggtaaagcgacat

SEQ ID NO: 1405390 - DNA, 22 bp, Artificial Sequence
  chemically synthesized
caaatatgtcgctttacccttt

SEQ ID NO: 1405391 - DNA, 22 bp, Artificial Sequence
  chemically synthesized
aaatatgtcgctttacccttta

SEQ ID NO: 1405392 - DNA, 22 bp, Artificial Sequence
  chemically synthesized
taccctttactttgaattacta

SEQ ID NO: 1405393 - DNA, 22 bp, Artificial Sequence
  chemically synthesized
accctttactttgaattactat

SEQ ID NO: 1405394 - DNA, 22 bp, Artificial Sequence
  chemically synthesized
ccctttactttgaattactatt

SEQ ID NO: 1405395 - DNA, 22 bp, Artificial Sequence
  chemically synthesized
tactttgaattactatttttca

SEQ ID NO: 1405396 - DNA, 22 bp, Artificial Sequence
  chemically synthesized
actttgaattactatttttcac

SEQ ID NO: 1405397 - DNA, 22 bp, Artificial Sequence
  chemically synthesized
ctttgaattactatttttcact

SEQ ID NO: 1405398 - DNA, 22 bp, Artificial Sequence
  chemically synthesized
tgaattactatttttcactgga

SEQ ID NO: 1405399 - DNA, 22 bp, Artificial Sequence
  chemically synthesized
gaattactatttttcactggat

SEQ ID NO: 1405400 - DNA, 22 bp, Artificial Sequence
  chemically synthesized
aattactatttttcactggatt

SEQ ID NO: 1405401 - DNA, 22 bp, Artificial Sequence
  chemically synthesized
aacagaaagaaagcaaatccag

SEQ ID NO: 1405402 - DNA, 22 bp, Artificial Sequence
  chemically synthesized
ctatttttcactggatttgctt

SEQ ID NO: 1405403 - DNA, 22 bp, Artificial Sequence
  chemically synthesized
tttttcactggatttgctttct

SEQ ID NO: 1405404 - DNA, 22 bp, Artificial Sequence
  chemically synthesized
ttcactggatttgctttctttc

SEQ ID NO: 1405405 - DNA, 22 bp, Artificial Sequence
  chemically synthesized
tcactggatttgctttctttct

SEQ ID NO: 1405406 - DNA, 22 bp, Artificial Sequence
  chemically synthesized
cactggatttgctttctttctg

SEQ ID NO: 1405407 - DNA, 22 bp, Artificial Sequence
  chemically synthesized
actggatttgctttctttctgt

SEQ ID NO: 1405408 - DNA, 22 bp, Artificial Sequence
  chemically synthesized
gatttgctttctttctgttcag

SEQ ID NO: 1405409 - DNA, 22 bp, Artificial Sequence
  chemically synthesized
gctttctttctgttcagttatc

SEQ ID NO: 1405410 - DNA, 22 bp, Artificial Sequence
  chemically synthesized
ctttctttctgttcagttatca

SEQ ID NO: 1405411 - DNA, 22 bp, Artificial Sequence
  chemically synthesized
tctttctgttcagttatcattt

SEQ ID NO: 1405412 - DNA, 22 bp, Artificial Sequence
  chemically synthesized
ctttctgttcagttatcatttt

SEQ ID NO: 1405413 - DNA, 22 bp, Artificial Sequence
  chemically synthesized
tttctgttcagttatcattttg

SEQ ID NO: 1405414 - DNA, 22 bp, Artificial Sequence
  chemically synthesized
tctgttcagttatcattttgct

SEQ ID NO: 1405415 - DNA, 22 bp, Artificial Sequence
  chemically synthesized
ctgttcagttatcattttgctc

SEQ ID NO: 1405416 - DNA, 22 bp, Artificial Sequence
  chemically synthesized
tgttcagttatcattttgctct

SEQ ID NO: 1405417 - DNA, 22 bp, Artificial Sequence
  chemically synthesized
gcaagtccatcaaagagcaaaa

SEQ ID NO: 1405418 - DNA, 22 bp, Artificial Sequence
  chemically synthesized
ttcagttatcattttgctcttt

SEQ ID NO: 1405419 - DNA, 22 bp, Artificial Sequence
  chemically synthesized
agttatcattttgctctttgat

SEQ ID NO: 1405420 - DNA, 22 bp, Artificial Sequence
  chemically synthesized
tcattttgctctttgatggact

SEQ ID NO: 1405421 - DNA, 22 bp, Artificial Sequence
  chemically synthesized
tgctctttgatggacttgccag

SEQ ID NO: 1405422 - DNA, 22 bp, Artificial Sequence
  chemically synthesized
gctctttgatggacttgccagt

SEQ ID NO: 1405423 - DNA, 22 bp, Artificial Sequence
  chemically synthesized
ctctttgatggacttgccagtt

SEQ ID NO: 1405424 - DNA, 22 bp, Artificial Sequence
  chemically synthesized
tttgatggacttgccagttttt

SEQ ID NO: 1405425 - DNA, 22 bp, Artificial Sequence
  chemically synthesized
tgatggacttgccagtttttcc

SEQ ID NO: 1405426 - DNA, 22 bp, Artificial Sequence
  chemically synthesized
gatggacttgccagtttttcca

SEQ ID NO: 1405427 - DNA, 22 bp, Artificial Sequence
  chemically synthesized
gtgtgagtgatgtggaaaaact

SEQ ID NO: 1405428 - DNA, 22 bp, Artificial Sequence
  chemically synthesized
atggacttgccagtttttccac

SEQ ID NO: 1405429 - DNA, 22 bp, Artificial Sequence
  chemically synthesized
ctagtgtgagtgatgtggaaaa

SEQ ID NO: 1405430 - DNA, 22 bp, Artificial Sequence
  chemically synthesized
gccagtttttccacatcactca

SEQ ID NO: 1405431 - DNA, 22 bp, Artificial Sequence
  chemically synthesized
ccagtttttccacatcactcac

SEQ ID NO: 1405432 - DNA, 22 bp, Artificial Sequence
  chemically synthesized
cggagttcctagtgtgagtgat

SEQ ID NO: 1405433 - DNA, 22 bp, Artificial Sequence
  chemically synthesized
ccggagttcctagtgtgagtga

SEQ ID NO: 1405434 - DNA, 22 bp, Artificial Sequence
  chemically synthesized
ttccacatcactcacactagga

SEQ ID NO: 1405435 - DNA, 22 bp, Artificial Sequence
  chemically synthesized
tccacatcactcacactaggaa

SEQ ID NO: 1405436 - DNA, 22 bp, Artificial Sequence
  chemically synthesized
ccacatcactcacactaggaac

SEQ ID NO: 1405437 - DNA, 22 bp, Artificial Sequence
  chemically synthesized
gaggtttccggagttcctagtg

SEQ ID NO: 1405438 - DNA, 22 bp, Artificial Sequence
  chemically synthesized
cacatcactcacactaggaact

SEQ ID NO: 1405439 - DNA, 22 bp, Artificial Sequence
  chemically synthesized
agctagaggtttccggagttcc

SEQ ID NO: 1405440 - DNA, 22 bp, Artificial Sequence
  chemically synthesized
acactaggaactccggaaacct

SEQ ID NO: 1405441 - DNA, 22 bp, Artificial Sequence
  chemically synthesized
ggactgagctagaggtttccgg

SEQ ID NO: 1405442 - DNA, 22 bp, Artificial Sequence
  chemically synthesized
aggactgagctagaggtttccg

SEQ ID NO: 1405443 - DNA, 22 bp, Artificial Sequence
  chemically synthesized
acttaggactgagctagaggtt

SEQ ID NO: 1405444 - DNA, 22 bp, Artificial Sequence
  chemically synthesized
ggaactccggaaacctctagct

SEQ ID NO: 1405445 - DNA, 22 bp, Artificial Sequence
  chemically synthesized
cggaaacctctagctcagtcct

SEQ ID NO: 1405446 - DNA, 22 bp, Artificial Sequence
  chemically synthesized
tagctcagtcctaagtcagctt

SEQ ID NO: 1405447 - DNA, 22 bp, Artificial Sequence
  chemically synthesized
gctcagtcctaagtcagcttta

SEQ ID NO: 1405448 - DNA, 22 bp, Artificial Sequence
  chemically synthesized
tgaacccagacagtaaagctga

SEQ ID NO: 1405449 - DNA, 22 bp, Artificial Sequence
  chemically synthesized
agtcctaagtcagctttactgt

SEQ ID NO: 1405450 - DNA, 22 bp, Artificial Sequence
  chemically synthesized
agtcagctttactgtctgggtt

SEQ ID NO: 1405451 - DNA, 22 bp, Artificial Sequence
  chemically synthesized
tactgtctgggttcacagttgc

SEQ ID NO: 1405452 - DNA, 22 bp, Artificial Sequence
  chemically synthesized
actgtctgggttcacagttgct

SEQ ID NO: 1405453 - DNA, 22 bp, Artificial Sequence
  chemically synthesized
ctgtctgggttcacagttgctg

SEQ ID NO: 1405454 - DNA, 22 bp, Artificial Sequence
  chemically synthesized
agcagagagcaacagcaactgt

SEQ ID NO: 1405455 - DNA, 22 bp, Artificial Sequence
  chemically synthesized
tctgggttcacagttgctgttg

SEQ ID NO: 1405456 - DNA, 22 bp, Artificial Sequence
  chemically synthesized
ggttcacagttgctgttgctct

SEQ ID NO: 1405457 - DNA, 22 bp, Artificial Sequence
  chemically synthesized
acagttgctgttgctctctgct

SEQ ID NO: 1405458 - DNA, 22 bp, Artificial Sequence
  chemically synthesized
cagtgaatagctaagcagagag

SEQ ID NO: 1405459 - DNA, 22 bp, Artificial Sequence
  chemically synthesized
acagtgaatagctaagcagaga

SEQ ID NO: 1405460 - DNA, 22 bp, Artificial Sequence
  chemically synthesized
ctgttgctctctgcttagctat

SEQ ID NO: 1405461 - DNA, 22 bp, Artificial Sequence
  chemically synthesized
ttgctctctgcttagctattca

SEQ ID NO: 1405462 - DNA, 22 bp, Artificial Sequence
  chemically synthesized
ctctctgcttagctattcactg

SEQ ID NO: 1405463 - DNA, 22 bp, Artificial Sequence
  chemically synthesized
tctgcttagctattcactgtaa

SEQ ID NO: 1405464 - DNA, 22 bp, Artificial Sequence
  chemically synthesized
tgcttagctattcactgtaaat

SEQ ID NO: 1405465 - DNA, 22 bp, Artificial Sequence
  chemically synthesized
cttagctattcactgtaaatat

SEQ ID NO: 1405466 - DNA, 22 bp, Artificial Sequence
  chemically synthesized
agctattcactgtaaatatttt

SEQ ID NO: 1405467 - DNA, 22 bp, Artificial Sequence
  chemically synthesized
gctattcactgtaaatattttt

SEQ ID NO: 1405468 - DNA, 22 bp, Artificial Sequence
  chemically synthesized
tgtggatgagaagagaaaaata

SEQ ID NO: 1405469 - DNA, 22 bp, Artificial Sequence
  chemically synthesized
ttcactgtaaatatttttctct

SEQ ID NO: 1405470 - DNA, 22 bp, Artificial Sequence
  chemically synthesized
atgtggatgagaagagaaaaat

SEQ ID NO: 1405471 - DNA, 22 bp, Artificial Sequence
  chemically synthesized
actgtaaatatttttctcttct

SEQ ID NO: 1405472 - DNA, 22 bp, Artificial Sequence
  chemically synthesized
taaatatttttctcttctcatc

SEQ ID NO: 1405473 - DNA, 22 bp, Artificial Sequence
  chemically synthesized
ttctcttctcatccacataaac

SEQ ID NO: 1405474 - DNA, 22 bp, Artificial Sequence
  chemically synthesized
gagacgaacgtggtttatgtgg

SEQ ID NO: 1405475 - DNA, 22 bp, Artificial Sequence
  chemically synthesized
tctcttctcatccacataaacc

SEQ ID NO: 1405476 - DNA, 22 bp, Artificial Sequence
  chemically synthesized
agagacgaacgtggtttatgtg

SEQ ID NO: 1405477 - DNA, 22 bp, Artificial Sequence
  chemically synthesized
ctcttctcatccacataaacca

SEQ ID NO: 1405478 - DNA, 22 bp, Artificial Sequence
  chemically synthesized
tcttctcatccacataaaccac

SEQ ID NO: 1405479 - DNA, 22 bp, Artificial Sequence
  chemically synthesized
ttctcatccacataaaccacgt

SEQ ID NO: 1405480 - DNA, 22 bp, Artificial Sequence
  chemically synthesized
ctcatccacataaaccacgttc

SEQ ID NO: 1405481 - DNA, 22 bp, Artificial Sequence
  chemically synthesized
tcatccacataaaccacgttcg

SEQ ID NO: 1405482 - DNA, 22 bp, Artificial Sequence
  chemically synthesized
aggaatttagagacgaacgtgg

SEQ ID NO: 1405483 - DNA, 22 bp, Artificial Sequence
  chemically synthesized
atccacataaaccacgttcgtc

SEQ ID NO: 1405484 - DNA, 22 bp, Artificial Sequence
  chemically synthesized
agatacagtccctgaggaattt

SEQ ID NO: 1405485 - DNA, 22 bp, Artificial Sequence
  chemically synthesized
gtctctaaattcctcagggact

SEQ ID NO: 1405486 - DNA, 22 bp, Artificial Sequence
  chemically synthesized
taaattcctcagggactgtatc

SEQ ID NO: 1405487 - DNA, 22 bp, Artificial Sequence
  chemically synthesized
aattcctcagggactgtatctt

SEQ ID NO: 1405488 - DNA, 22 bp, Artificial Sequence
  chemically synthesized
gagcaagatgactaagatacag

SEQ ID NO: 1405489 - DNA, 22 bp, Artificial Sequence
  chemically synthesized
ctcagggactgtatcttagtca

SEQ ID NO: 1405490 - DNA, 22 bp, Artificial Sequence
  chemically synthesized
tgctagagcaagatgactaaga

SEQ ID NO: 1405491 - DNA, 22 bp, Artificial Sequence
  chemically synthesized
agggactgtatcttagtcatct

SEQ ID NO: 1405492 - DNA, 22 bp, Artificial Sequence
  chemically synthesized
tgtgctagagcaagatgactaa

SEQ ID NO: 1405493 - DNA, 22 bp, Artificial Sequence
  chemically synthesized
tatcttagtcatcttgctctag

SEQ ID NO: 1405494 - DNA, 22 bp, Artificial Sequence
  chemically synthesized
ccaggctctgtgctagagcaag

SEQ ID NO: 1405495 - DNA, 22 bp, Artificial Sequence
  chemically synthesized
actgccaggctctgtgctagag

SEQ ID NO: 1405496 - DNA, 22 bp, Artificial Sequence
  chemically synthesized
agtcatcttgctctagcacaga

SEQ ID NO: 1405497 - DNA, 22 bp, Artificial Sequence
  chemically synthesized
taactgccaggctctgtgctag

SEQ ID NO: 1405498 - DNA, 22 bp, Artificial Sequence
  chemically synthesized
gtcatcttgctctagcacagag

SEQ ID NO: 1405499 - DNA, 22 bp, Artificial Sequence
  chemically synthesized
ataaattctaactgccaggctc

SEQ ID NO: 1405500 - DNA, 22 bp, Artificial Sequence
  chemically synthesized
gctctagcacagagcctggcag

SEQ ID NO: 1405501 - DNA, 22 bp, Artificial Sequence
  chemically synthesized
ctctagcacagagcctggcagt

SEQ ID NO: 1405502 - DNA, 22 bp, Artificial Sequence
  chemically synthesized
ttgataaattctaactgccagg

SEQ ID NO: 1405503 - DNA, 22 bp, Artificial Sequence
  chemically synthesized
attgataaattctaactgccag

SEQ ID NO: 1405504 - DNA, 22 bp, Artificial Sequence
  chemically synthesized
tagcacagagcctggcagttag

SEQ ID NO: 1405505 - DNA, 22 bp, Artificial Sequence
  chemically synthesized
gcacagagcctggcagttagaa

SEQ ID NO: 1405506 - DNA, 22 bp, Artificial Sequence
  chemically synthesized
gcagttagaatttatcaataaa

SEQ ID NO: 1405507 - DNA, 22 bp, Artificial Sequence
  chemically synthesized
atccaacaaatatttattgata

SEQ ID NO: 1405508 - DNA, 22 bp, Artificial Sequence
  chemically synthesized
attcatccaacaaatatttatt

SEQ ID NO: 1405509 - DNA, 22 bp, Artificial Sequence
  chemically synthesized
cattcatccaacaaatatttat

SEQ ID NO: 1405510 - DNA, 22 bp, Artificial Sequence
  chemically synthesized
tcattcatccaacaaatattta

SEQ ID NO: 1405511 - DNA, 22 bp, Artificial Sequence
  chemically synthesized
gaatttatcaataaatatttgt

SEQ ID NO: 1405512 - DNA, 22 bp, Artificial Sequence
  chemically synthesized
ttcattcatccaacaaatattt

SEQ ID NO: 1405513 - DNA, 22 bp, Artificial Sequence
  chemically synthesized
cttttcattcatccaacaaata

SEQ ID NO: 1405514 - DNA, 22 bp, Artificial Sequence
  chemically synthesized
atcaataaatatttgttggatg

SEQ ID NO: 1405515 - DNA, 22 bp, Artificial Sequence
  chemically synthesized
ctgcttttcattcatccaacaa

SEQ ID NO: 1405516 - DNA, 22 bp, Artificial Sequence
  chemically synthesized
tcaataaatatttgttggatga

SEQ ID NO: 1405517 - DNA, 22 bp, Artificial Sequence
  chemically synthesized
tgctgcttttcattcatccaac

SEQ ID NO: 1405518 - DNA, 22 bp, Artificial Sequence
  chemically synthesized
ctgctgcttttcattcatccaa

SEQ ID NO: 1405519 - DNA, 22 bp, Artificial Sequence
  chemically synthesized
tttctgctgcttttcattcatc

SEQ ID NO: 1405520 - DNA, 22 bp, Artificial Sequence
  chemically synthesized
gttggatgaatgaaaagcagca

SEQ ID NO: 1405521 - DNA, 22 bp, Artificial Sequence
  chemically synthesized
ttggatgaatgaaaagcagcag

SEQ ID NO: 1405522 - DNA, 22 bp, Artificial Sequence
  chemically synthesized
gatgaatgaaaagcagcagaaa

SEQ ID NO: 1405523 - DNA, 22 bp, Artificial Sequence
  chemically synthesized
aaatgaaaggttgtttctgctg

SEQ ID NO: 1405524 - DNA, 22 bp, Artificial Sequence
  chemically synthesized
gagcccaccaactgaaatgaaa

SEQ ID NO: 1405525 - DNA, 22 bp, Artificial Sequence
  chemically synthesized
tcatttcagttggtgggctcta

SEQ ID NO: 1405526 - DNA, 22 bp, Artificial Sequence
  chemically synthesized
catttcagttggtgggctctaa

SEQ ID NO: 1405527 - DNA, 22 bp, Artificial Sequence
  chemically synthesized
atttcagttggtgggctctaat

SEQ ID NO: 1405528 - DNA, 22 bp, Artificial Sequence
  chemically synthesized
ggtcatccagacaggattagag

SEQ ID NO: 1405529 - DNA, 22 bp, Artificial Sequence
  chemically synthesized
cagttggtgggctctaatcctg

SEQ ID NO: 1405530 - DNA, 22 bp, Artificial Sequence
  chemically synthesized
agttggtgggctctaatcctgt

SEQ ID NO: 1405531 - DNA, 22 bp, Artificial Sequence
  chemically synthesized
cattaggtcatccagacaggat

SEQ ID NO: 1405532 - DNA, 22 bp, Artificial Sequence
  chemically synthesized
gtgggctctaatcctgtctgga

SEQ ID NO: 1405533 - DNA, 22 bp, Artificial Sequence
  chemically synthesized
tccattaggtcatccagacagg

SEQ ID NO: 1405534 - DNA, 22 bp, Artificial Sequence
  chemically synthesized
ctccattaggtcatccagacag

SEQ ID NO: 1405535 - DNA, 22 bp, Artificial Sequence
  chemically synthesized
tttctccattaggtcatccaga

SEQ ID NO: 1405536 - DNA, 22 bp, Artificial Sequence
  chemically synthesized
taatcctgtctggatgacctaa

SEQ ID NO: 1405537 - DNA, 22 bp, Artificial Sequence
  chemically synthesized
atcctgtctggatgacctaatg

SEQ ID NO: 1405538 - DNA, 22 bp, Artificial Sequence
  chemically synthesized
tctggatgacctaatggagaaa

SEQ ID NO: 1405539 - DNA, 22 bp, Artificial Sequence
  chemically synthesized
gatgacctaatggagaaataga

SEQ ID NO: 1405540 - DNA, 22 bp, Artificial Sequence
  chemically synthesized
atggagaaatagactctgtttc

SEQ ID NO: 1405541 - DNA, 22 bp, Artificial Sequence
  chemically synthesized
gtggccacagtggcaggaaaca

SEQ ID NO: 1405542 - DNA, 22 bp, Artificial Sequence
  chemically synthesized
ggtggccacagtggcaggaaac

SEQ ID NO: 1405543 - DNA, 22 bp, Artificial Sequence
  chemically synthesized
tggtggccacagtggcaggaaa

SEQ ID NO: 1405544 - DNA, 22 bp, Artificial Sequence
  chemically synthesized
gttttggtggccacagtggcag

SEQ ID NO: 1405545 - DNA, 22 bp, Artificial Sequence
  chemically synthesized
tgtttcctgccactgtggccac

SEQ ID NO: 1405546 - DNA, 22 bp, Artificial Sequence
  chemically synthesized
tttcctgccactgtggccacca

SEQ ID NO: 1405547 - DNA, 22 bp, Artificial Sequence
  chemically synthesized
atgggctggttttggtggccac

SEQ ID NO: 1405548 - DNA, 22 bp, Artificial Sequence
  chemically synthesized
cctgccactgtggccaccaaaa

SEQ ID NO: 1405549 - DNA, 22 bp, Artificial Sequence
  chemically synthesized
ctgccactgtggccaccaaaac

SEQ ID NO: 1405550 - DNA, 22 bp, Artificial Sequence
  chemically synthesized
ccactgtggccaccaaaaccag

SEQ ID NO: 1405551 - DNA, 22 bp, Artificial Sequence
  chemically synthesized
acccattcatgggctggttttg

SEQ ID NO: 1405552 - DNA, 22 bp, Artificial Sequence
  chemically synthesized
ctgacccattcatgggctggtt

SEQ ID NO: 1405553 - DNA, 22 bp, Artificial Sequence
  chemically synthesized
tggccaccaaaaccagcccatg

SEQ ID NO: 1405554 - DNA, 22 bp, Artificial Sequence
  chemically synthesized
gctgctgacccattcatgggct

SEQ ID NO: 1405555 - DNA, 22 bp, Artificial Sequence
  chemically synthesized
ggctgctgacccattcatgggc

SEQ ID NO: 1405556 - DNA, 22 bp, Artificial Sequence
  chemically synthesized
tggctgctgacccattcatggg

SEQ ID NO: 1405557 - DNA, 22 bp, Artificial Sequence
  chemically synthesized
cctttggctgctgacccattca

SEQ ID NO: 1405558 - DNA, 22 bp, Artificial Sequence
  chemically synthesized
tccctttggctgctgacccatt

SEQ ID NO: 1405559 - DNA, 22 bp, Artificial Sequence
  chemically synthesized
ctctccctttggctgctgaccc

SEQ ID NO: 1405560 - DNA, 22 bp, Artificial Sequence
  chemically synthesized
aggttcctctccctttggctgc

SEQ ID NO: 1405561 - DNA, 22 bp, Artificial Sequence
  chemically synthesized
gtgagtaggaatctcaggttcc

SEQ ID NO: 1405562 - DNA, 22 bp, Artificial Sequence
  chemically synthesized
catgtgatggacacattagtga

SEQ ID NO: 1405563 - DNA, 22 bp, Artificial Sequence
  chemically synthesized
agattcctactcactaatgtgt

SEQ ID NO: 1405564 - DNA, 22 bp, Artificial Sequence
  chemically synthesized
ctactcactaatgtgtccatca

SEQ ID NO: 1405565 - DNA, 22 bp, Artificial Sequence
  chemically synthesized
ctcactaatgtgtccatcacat

SEQ ID NO: 1405566 - DNA, 22 bp, Artificial Sequence
  chemically synthesized
agtaaaagcctgcatgtgatgg

SEQ ID NO: 1405567 - DNA, 22 bp, Artificial Sequence
  chemically synthesized
actaatgtgtccatcacatgca

SEQ ID NO: 1405568 - DNA, 22 bp, Artificial Sequence
  chemically synthesized
atgtgtccatcacatgcaggct

SEQ ID NO: 1405569 - DNA, 22 bp, Artificial Sequence
  chemically synthesized
tgacaagtgtaaaaaggagatt

SEQ ID NO: 1405570 - DNA, 22 bp, Artificial Sequence
  chemically synthesized
tatgacaagtgtaaaaaggaga

SEQ ID NO: 1405571 - DNA, 22 bp, Artificial Sequence
  chemically synthesized
ttacttaatctcctttttacac

SEQ ID NO: 1405572 - DNA, 22 bp, Artificial Sequence
  chemically synthesized
tacttaatctcctttttacact

SEQ ID NO: 1405573 - DNA, 22 bp, Artificial Sequence
  chemically synthesized
tgttctatgacaagtgtaaaaa

SEQ ID NO: 1405574 - DNA, 22 bp, Artificial Sequence
  chemically synthesized
acttaatctcctttttacactt

SEQ ID NO: 1405575 - DNA, 22 bp, Artificial Sequence
  chemically synthesized
atgttctatgacaagtgtaaaa

SEQ ID NO: 1405576 - DNA, 22 bp, Artificial Sequence
  chemically synthesized
cttaatctcctttttacacttg

SEQ ID NO: 1405577 - DNA, 22 bp, Artificial Sequence
  chemically synthesized
aatctcctttttacacttgtca

SEQ ID NO: 1405578 - DNA, 22 bp, Artificial Sequence
  chemically synthesized
atttatgttctatgacaagtgt

SEQ ID NO: 1405579 - DNA, 22 bp, Artificial Sequence
  chemically synthesized
atctcctttttacacttgtcat

SEQ ID NO: 1405580 - DNA, 22 bp, Artificial Sequence
  chemically synthesized
ctttttacacttgtcatagaac

SEQ ID NO: 1405581 - DNA, 22 bp, Artificial Sequence
  chemically synthesized
tttacacttgtcatagaacata

SEQ ID NO: 1405582 - DNA, 22 bp, Artificial Sequence
  chemically synthesized
ttacacttgtcatagaacataa

SEQ ID NO: 1405583 - DNA, 22 bp, Artificial Sequence
  chemically synthesized
tacacttgtcatagaacataaa

SEQ ID NO: 1405584 - DNA, 22 bp, Artificial Sequence
  chemically synthesized
acacttgtcatagaacataaat

SEQ ID NO: 1405585 - DNA, 22 bp, Artificial Sequence
  chemically synthesized
cacttgtcatagaacataaatg

SEQ ID NO: 1405586 - DNA, 22 bp, Artificial Sequence
  chemically synthesized
ggggagatgtgggactcattta

SEQ ID NO: 1405587 - DNA, 22 bp, Artificial Sequence
  chemically synthesized
gtcatagaacataaatgagtcc

SEQ ID NO: 1405588 - DNA, 22 bp, Artificial Sequence
  chemically synthesized
aggggagatgtgggactcattt

SEQ ID NO: 1405589 - DNA, 22 bp, Artificial Sequence
  chemically synthesized
tcatagaacataaatgagtccc

SEQ ID NO: 1405590 - DNA, 22 bp, Artificial Sequence
  chemically synthesized
taggggagatgtgggactcatt

SEQ ID NO: 1405591 - DNA, 22 bp, Artificial Sequence
  chemically synthesized
tatgggttttaggggagatgtg

SEQ ID NO: 1405592 - DNA, 22 bp, Artificial Sequence
  chemically synthesized
aaattgtatgggttttagggga

SEQ ID NO: 1405593 - DNA, 22 bp, Artificial Sequence
  chemically synthesized
acctgaaattgtatgggtttta

SEQ ID NO: 1405594 - DNA, 22 bp, Artificial Sequence
  chemically synthesized
atgctaacctgaaattgtatgg

SEQ ID NO: 1405595 - DNA, 22 bp, Artificial Sequence
  chemically synthesized
ccctaaaacccatacaatttca

SEQ ID NO: 1405596 - DNA, 22 bp, Artificial Sequence
  chemically synthesized
aaacccatacaatttcaggtta

SEQ ID NO: 1405597 - DNA, 22 bp, Artificial Sequence
  chemically synthesized
aaagtgacactaatgctaacct

SEQ ID NO: 1405598 - DNA, 22 bp, Artificial Sequence
  chemically synthesized
ttgaaagtgacactaatgctaa

SEQ ID NO: 1405599 - DNA, 22 bp, Artificial Sequence
  chemically synthesized
gattattgaaagtgacactaat

SEQ ID NO: 1405600 - DNA, 22 bp, Artificial Sequence
  chemically synthesized
caggttagcattagtgtcactt

SEQ ID NO: 1405601 - DNA, 22 bp, Artificial Sequence
  chemically synthesized
aggttagcattagtgtcacttt

SEQ ID NO: 1405602 - DNA, 22 bp, Artificial Sequence
  chemically synthesized
gcattagtgtcactttcaataa

SEQ ID NO: 1405603 - DNA, 22 bp, Artificial Sequence
  chemically synthesized
gtgtcactttcaataatccagc

SEQ ID NO: 1405604 - DNA, 22 bp, Artificial Sequence
  chemically synthesized
ggtccagcaacaataagctgga

SEQ ID NO: 1405605 - DNA, 22 bp, Artificial Sequence
  chemically synthesized
ttcggtccagcaacaataagct

SEQ ID NO: 1405606 - DNA, 22 bp, Artificial Sequence
  chemically synthesized
tcaataatccagcttattgttg

SEQ ID NO: 1405607 - DNA, 22 bp, Artificial Sequence
  chemically synthesized
caataatccagcttattgttgc

SEQ ID NO: 1405608 - DNA, 22 bp, Artificial Sequence
  chemically synthesized
aataatccagcttattgttgct

SEQ ID NO: 1405609 - DNA, 22 bp, Artificial Sequence
  chemically synthesized
taagtagaattgttcggtccag

SEQ ID NO: 1405610 - DNA, 22 bp, Artificial Sequence
  chemically synthesized
attgttgctggaccgaacaatt

SEQ ID NO: 1405611 - DNA, 22 bp, Artificial Sequence
  chemically synthesized
ttgttgctggaccgaacaattc

SEQ ID NO: 1405612 - DNA, 22 bp, Artificial Sequence
  chemically synthesized
ttgctggaccgaacaattctac

SEQ ID NO: 1405613 - DNA, 22 bp, Artificial Sequence
  chemically synthesized
tacatgctataagtagaattgt

SEQ ID NO: 1405614 - DNA, 22 bp, Artificial Sequence
  chemically synthesized
atacatgctataagtagaattg

SEQ ID NO: 1405615 - DNA, 22 bp, Artificial Sequence
  chemically synthesized
tatacatgctataagtagaatt

SEQ ID NO: 1405616 - DNA, 22 bp, Artificial Sequence
  chemically synthesized
ctggaccgaacaattctactta

SEQ ID NO: 1405617 - DNA, 22 bp, Artificial Sequence
  chemically synthesized
ttatacatgctataagtagaat

SEQ ID NO: 1405618 - DNA, 22 bp, Artificial Sequence
  chemically synthesized
ttttatacatgctataagtaga

SEQ ID NO: 1405619 - DNA, 22 bp, Artificial Sequence
  chemically synthesized
gaccgaacaattctacttatag

SEQ ID NO: 1405620 - DNA, 22 bp, Artificial Sequence
  chemically synthesized
cttttatacatgctataagtag

SEQ ID NO: 1405621 - DNA, 22 bp, Artificial Sequence
  chemically synthesized
gtacagatttcttttatacatg

SEQ ID NO: 1405622 - DNA, 22 bp, Artificial Sequence
  chemically synthesized
tacttatagcatgtataaaaga

SEQ ID NO: 1405623 - DNA, 22 bp, Artificial Sequence
  chemically synthesized
ctagtacagatttcttttatac

SEQ ID NO: 1405624 - DNA, 22 bp, Artificial Sequence
  chemically synthesized
actagtacagatttcttttata

SEQ ID NO: 1405625 - DNA, 22 bp, Artificial Sequence
  chemically synthesized
cttatagcatgtataaaagaaa

SEQ ID NO: 1405626 - DNA, 22 bp, Artificial Sequence
  chemically synthesized
tactagtacagatttcttttat

SEQ ID NO: 1405627 - DNA, 22 bp, Artificial Sequence
  chemically synthesized
ttactagtacagatttctttta

SEQ ID NO: 1405628 - DNA, 22 bp, Artificial Sequence
  chemically synthesized
atagcatgtataaaagaaatct

SEQ ID NO: 1405629 - DNA, 22 bp, Artificial Sequence
  chemically synthesized
tagcatgtataaaagaaatctg

SEQ ID NO: 1405630 - DNA, 22 bp, Artificial Sequence
  chemically synthesized
tttttactagtacagatttctt

SEQ ID NO: 1405631 - DNA, 22 bp, Artificial Sequence
  chemically synthesized
tactagtaaaaacagactatga

SEQ ID NO: 1405632 - DNA, 22 bp, Artificial Sequence
  chemically synthesized
gtaaaaacagactatgatggtc

SEQ ID NO: 1405633 - DNA, 22 bp, Artificial Sequence
  chemically synthesized
ccaggataaaatgtgataagga

SEQ ID NO: 1405634 - DNA, 22 bp, Artificial Sequence
  chemically synthesized
tgatggtccttatcacatttta

SEQ ID NO: 1405635 - DNA, 22 bp, Artificial Sequence
  chemically synthesized
taacactcccaggataaaatgt

SEQ ID NO: 1405636 - DNA, 22 bp, Artificial Sequence
  chemically synthesized
attataacactcccaggataaa

SEQ ID NO: 1405637 - DNA, 22 bp, Artificial Sequence
  chemically synthesized
atcacattttatcctgggagtg

SEQ ID NO: 1405638 - DNA, 22 bp, Artificial Sequence
  chemically synthesized
tcacattttatcctgggagtgt

SEQ ID NO: 1405639 - DNA, 22 bp, Artificial Sequence
  chemically synthesized
caactgattataacactcccag

SEQ ID NO: 1405640 - DNA, 22 bp, Artificial Sequence
  chemically synthesized
ttacaactgattataacactcc

SEQ ID NO: 1405641 - DNA, 22 bp, Artificial Sequence
  chemically synthesized
tatcctgggagtgttataatca

SEQ ID NO: 1405642 - DNA, 22 bp, Artificial Sequence
  chemically synthesized
atcctgggagtgttataatcag

SEQ ID NO: 1405643 - DNA, 22 bp, Artificial Sequence
  chemically synthesized
tcctgggagtgttataatcagt

SEQ ID NO: 1405644 - DNA, 22 bp, Artificial Sequence
  chemically synthesized
ggagtgttataatcagttgtaa

SEQ ID NO: 1405645 - DNA, 22 bp, Artificial Sequence
  chemically synthesized
gtcatgacattgttacaactga

SEQ ID NO: 1405646 - DNA, 22 bp, Artificial Sequence
  chemically synthesized
tggtcatgacattgttacaact

SEQ ID NO: 1405647 - DNA, 22 bp, Artificial Sequence
  chemically synthesized
agctctggtcatgacattgtta

SEQ ID NO: 1405648 - DNA, 22 bp, Artificial Sequence
  chemically synthesized
taatcagttgtaacaatgtcat

SEQ ID NO: 1405649 - DNA, 22 bp, Artificial Sequence
  chemically synthesized
taacaatgtcatgaccagagct

SEQ ID NO: 1405650 - DNA, 22 bp, Artificial Sequence
  chemically synthesized
tcagcatcattcagctctggtc

SEQ ID NO: 1405651 - DNA, 22 bp, Artificial Sequence
  chemically synthesized
atcagcatcattcagctctggt

SEQ ID NO: 1405652 - DNA, 22 bp, Artificial Sequence
  chemically synthesized
agggaaaataaacttatcagca

SEQ ID NO: 1405653 - DNA, 22 bp, Artificial Sequence
  chemically synthesized
aatgatgctgataagtttattt

SEQ ID NO: 1405654 - DNA, 22 bp, Artificial Sequence
  chemically synthesized
tgaatacaaagagctaagggaa

SEQ ID NO: 1405655 - DNA, 22 bp, Artificial Sequence
  chemically synthesized
ataagtttattttcccttagct

SEQ ID NO: 1405656 - DNA, 22 bp, Artificial Sequence
  chemically synthesized
attttcccttagctctttgtat

SEQ ID NO: 1405657 - DNA, 22 bp, Artificial Sequence
  chemically synthesized
ttttcccttagctctttgtatt

SEQ ID NO: 1405658 - DNA, 22 bp, Artificial Sequence
  chemically synthesized
aagacagggttatgaatacaaa

SEQ ID NO: 1405659 - DNA, 22 bp, Artificial Sequence
  chemically synthesized
tcccttagctctttgtattcat

SEQ ID NO: 1405660 - DNA, 22 bp, Artificial Sequence
  chemically synthesized
gaagacagggttatgaatacaa

SEQ ID NO: 1405661 - DNA, 22 bp, Artificial Sequence
  chemically synthesized
cccttagctctttgtattcata

SEQ ID NO: 1405662 - DNA, 22 bp, Artificial Sequence
  chemically synthesized
ccttagctctttgtattcataa

SEQ ID NO: 1405663 - DNA, 22 bp, Artificial Sequence
  chemically synthesized
agctctttgtattcataaccct

SEQ ID NO: 1405664 - DNA, 22 bp, Artificial Sequence
  chemically synthesized
caatttgaagacagggttatga

SEQ ID NO: 1405665 - DNA, 22 bp, Artificial Sequence
  chemically synthesized
gctctttgtattcataaccctg

SEQ ID NO: 1405666 - DNA, 22 bp, Artificial Sequence
  chemically synthesized
tttgtattcataaccctgtctt

SEQ ID NO: 1405667 - DNA, 22 bp, Artificial Sequence
  chemically synthesized
tgttgcaatttgaagacagggt

SEQ ID NO: 1405668 - DNA, 22 bp, Artificial Sequence
  chemically synthesized
tgtattcataaccctgtcttca

SEQ ID NO: 1405669 - DNA, 22 bp, Artificial Sequence
  chemically synthesized
gtattcataaccctgtcttcaa

SEQ ID NO: 1405670 - DNA, 22 bp, Artificial Sequence
  chemically synthesized
tattcataaccctgtcttcaaa

SEQ ID NO: 1405671 - DNA, 22 bp, Artificial Sequence
  chemically synthesized
acattatgttgcaatttgaaga

SEQ ID NO: 1405672 - DNA, 22 bp, Artificial Sequence
  chemically synthesized
ataaccctgtcttcaaattgca

SEQ ID NO: 1405673 - DNA, 22 bp, Artificial Sequence
  chemically synthesized
tcttcaaattgcaacataatgt

SEQ ID NO: 1405674 - DNA, 22 bp, Artificial Sequence
  chemically synthesized
cagaagaaatattgacattatg

SEQ ID NO: 1405675 - DNA, 22 bp, Artificial Sequence
  chemically synthesized
ccagaagaaatattgacattat

SEQ ID NO: 1405676 - DNA, 22 bp, Artificial Sequence
  chemically synthesized
caaattgcaacataatgtcaat

SEQ ID NO: 1405677 - DNA, 22 bp, Artificial Sequence
  chemically synthesized
aaattgcaacataatgtcaata

SEQ ID NO: 1405678 - DNA, 22 bp, Artificial Sequence
  chemically synthesized
caacataatgtcaatatttctt

SEQ ID NO: 1405679 - DNA, 22 bp, Artificial Sequence
  chemically synthesized
tcaaatttccagaagaaatatt

SEQ ID NO: 1405680 - DNA, 22 bp, Artificial Sequence
  chemically synthesized
atcaaatttccagaagaaatat

SEQ ID NO: 1405681 - DNA, 22 bp, Artificial Sequence
  chemically synthesized
cttctggaaatttgataagcac

SEQ ID NO: 1405682 - DNA, 22 bp, Artificial Sequence
  chemically synthesized
ttctggaaatttgataagcacc

SEQ ID NO: 1405683 - DNA, 22 bp, Artificial Sequence
  chemically synthesized
aaggtaaatggatggtgcttat

SEQ ID NO: 1405684 - DNA, 22 bp, Artificial Sequence
  chemically synthesized
ctggaaatttgataagcaccat

SEQ ID NO: 1405685 - DNA, 22 bp, Artificial Sequence
  chemically synthesized
tggaaatttgataagcaccatc

SEQ ID NO: 1405686 - DNA, 22 bp, Artificial Sequence
  chemically synthesized
gaaatttgataagcaccatcca

SEQ ID NO: 1405687 - DNA, 22 bp, Artificial Sequence
  chemically synthesized
gataagcaccatccatttacct

SEQ ID NO: 1405688 - DNA, 22 bp, Artificial Sequence
  chemically synthesized
ataagcaccatccatttacctt

SEQ ID NO: 1405689 - DNA, 22 bp, Artificial Sequence
  chemically synthesized
tcaatgtacacctgaaggtaaa

SEQ ID NO: 1405690 - DNA, 22 bp, Artificial Sequence
  chemically synthesized
ctgtcaatgtacacctgaaggt

SEQ ID NO: 1405691 - DNA, 22 bp, Artificial Sequence
  chemically synthesized
attgctgtcaatgtacacctga

SEQ ID NO: 1405692 - DNA, 22 bp, Artificial Sequence
  chemically synthesized
accttcaggtgtacattgacag

SEQ ID NO: 1405693 - DNA, 22 bp, Artificial Sequence
  chemically synthesized
ccttcaggtgtacattgacagc

SEQ ID NO: 1405694 - DNA, 22 bp, Artificial Sequence
  chemically synthesized
caggtgtacattgacagcaatt

SEQ ID NO: 1405695 - DNA, 22 bp, Artificial Sequence
  chemically synthesized
aggtgtacattgacagcaatta

SEQ ID NO: 1405696 - DNA, 22 bp, Artificial Sequence
  chemically synthesized
acagcaattaatctctgcgtac

SEQ ID NO: 1405697 - DNA, 22 bp, Artificial Sequence
  chemically synthesized
gaaacgtaggtggtacgcagag

SEQ ID NO: 1405698 - DNA, 22 bp, Artificial Sequence
  chemically synthesized
atctctgcgtaccacctacgtt

SEQ ID NO: 1405699 - DNA, 22 bp, Artificial Sequence
  chemically synthesized
tgcgtaccacctacgtttccag

SEQ ID NO: 1405700 - DNA, 22 bp, Artificial Sequence
  chemically synthesized
cgtaccacctacgtttccagtt

SEQ ID NO: 1405701 - DNA, 22 bp, Artificial Sequence
  chemically synthesized
tagaggaggtacaggatgacaa

SEQ ID NO: 1405702 - DNA, 22 bp, Artificial Sequence
  chemically synthesized
atagaggaggtacaggatgaca

SEQ ID NO: 1405703 - DNA, 22 bp, Artificial Sequence
  chemically synthesized
cgtttccagttgtcatcctgta

SEQ ID NO: 1405704 - DNA, 22 bp, Artificial Sequence
  chemically synthesized
ccagttgtcatcctgtacctcc

SEQ ID NO: 1405705 - DNA, 22 bp, Artificial Sequence
  chemically synthesized
cagttgtcatcctgtacctcct

SEQ ID NO: 1405706 - DNA, 22 bp, Artificial Sequence
  chemically synthesized
agcaaacgtttatagaggaggt

SEQ ID NO: 1405707 - DNA, 22 bp, Artificial Sequence
  chemically synthesized
gagcaaacgtttatagaggagg

SEQ ID NO: 1405708 - DNA, 22 bp, Artificial Sequence
  chemically synthesized
tgagcaaacgtttatagaggag

SEQ ID NO: 1405709 - DNA, 22 bp, Artificial Sequence
  chemically synthesized
tcatcctgtacctcctctataa

SEQ ID NO: 1405710 - DNA, 22 bp, Artificial Sequence
  chemically synthesized
ttgagcaaacgtttatagagga

SEQ ID NO: 1405711 - DNA, 22 bp, Artificial Sequence
  chemically synthesized
ttttgagcaaacgtttatagag

SEQ ID NO: 1405712 - DNA, 22 bp, Artificial Sequence
  chemically synthesized
tacctcctctataaacgtttgc

SEQ ID NO: 1405713 - DNA, 22 bp, Artificial Sequence
  chemically synthesized
agatgttcttttgagcaaacgt

SEQ ID NO: 1405714 - DNA, 22 bp, Artificial Sequence
  chemically synthesized
ctctataaacgtttgctcaaaa

SEQ ID NO: 1405715 - DNA, 22 bp, Artificial Sequence
  chemically synthesized
tataaacgtttgctcaaaagaa

SEQ ID NO: 1405716 - DNA, 22 bp, Artificial Sequence
  chemically synthesized
taaacgtttgctcaaaagaaca

SEQ ID NO: 1405717 - DNA, 22 bp, Artificial Sequence
  chemically synthesized
gacaaaagtaaaactgagatgt

SEQ ID NO: 1405718 - DNA, 22 bp, Artificial Sequence
  chemically synthesized
gctcaaaagaacatctcagttt

SEQ ID NO: 1405719 - DNA, 22 bp, Artificial Sequence
  chemically synthesized
ctcaaaagaacatctcagtttt

SEQ ID NO: 1405720 - DNA, 22 bp, Artificial Sequence
  chemically synthesized
tctagacaaaagtaaaactgag

SEQ ID NO: 1405721 - DNA, 22 bp, Artificial Sequence
  chemically synthesized
aaaagaacatctcagttttact

SEQ ID NO: 1405722 - DNA, 22 bp, Artificial Sequence
  chemically synthesized
agttttacttttgtctagacaa

SEQ ID NO: 1405723 - DNA, 22 bp, Artificial Sequence
  chemically synthesized
tacttttgtctagacaatattt

SEQ ID NO: 1405724 - DNA, 22 bp, Artificial Sequence
  chemically synthesized
acttttgtctagacaatatttt

SEQ ID NO: 1405725 - DNA, 22 bp, Artificial Sequence
  chemically synthesized
cttttgtctagacaatattttt

SEQ ID NO: 1405726 - DNA, 22 bp, Artificial Sequence
  chemically synthesized
ttgtctagacaatatttttacc

SEQ ID NO: 1405727 - DNA, 22 bp, Artificial Sequence
  chemically synthesized
tgtctagacaatatttttaccc

SEQ ID NO: 1405728 - DNA, 22 bp, Artificial Sequence
  chemically synthesized
gtctagacaatatttttaccca

SEQ ID NO: 1405729 - DNA, 22 bp, Artificial Sequence
  chemically synthesized
tctagacaatatttttacccat

SEQ ID NO: 1405730 - DNA, 22 bp, Artificial Sequence
  chemically synthesized
cagtaaataagcaaatgggtaa

SEQ ID NO: 1405731 - DNA, 22 bp, Artificial Sequence
  chemically synthesized
gacaatatttttacccatttgc

SEQ ID NO: 1405732 - DNA, 22 bp, Artificial Sequence
  chemically synthesized
aagtgcactgcagtaaataagc

SEQ ID NO: 1405733 - DNA, 22 bp, Artificial Sequence
  chemically synthesized
ttacccatttgcttatttactg

SEQ ID NO: 1405734 - DNA, 22 bp, Artificial Sequence
  chemically synthesized
tacccatttgcttatttactgc

SEQ ID NO: 1405735 - DNA, 22 bp, Artificial Sequence
  chemically synthesized
acccatttgcttatttactgca

SEQ ID NO: 1405736 - DNA, 22 bp, Artificial Sequence
  chemically synthesized
cccatttgcttatttactgcag

SEQ ID NO: 1405737 - DNA, 22 bp, Artificial Sequence
  chemically synthesized
cagcctaaagtgcactgcagta

SEQ ID NO: 1405738 - DNA, 22 bp, Artificial Sequence
  chemically synthesized
gcttatttactgcagtgcactt

SEQ ID NO: 1405739 - DNA, 22 bp, Artificial Sequence
  chemically synthesized
cttatttactgcagtgcacttt

SEQ ID NO: 1405740 - DNA, 22 bp, Artificial Sequence
  chemically synthesized
gggttacagcctaaagtgcact

SEQ ID NO: 1405741 - DNA, 22 bp, Artificial Sequence
  chemically synthesized
ggggttacagcctaaagtgcac

SEQ ID NO: 1405742 - DNA, 22 bp, Artificial Sequence
  chemically synthesized
tggggttacagcctaaagtgca

SEQ ID NO: 1405743 - DNA, 22 bp, Artificial Sequence
  chemically synthesized
atttactgcagtgcactttagg

SEQ ID NO: 1405744 - DNA, 22 bp, Artificial Sequence
  chemically synthesized
tttactgcagtgcactttaggc

SEQ ID NO: 1405745 - DNA, 22 bp, Artificial Sequence
  chemically synthesized
actgcagtgcactttaggctgt

SEQ ID NO: 1405746 - DNA, 22 bp, Artificial Sequence
  chemically synthesized
agctttggggttacagcctaaa

SEQ ID NO: 1405747 - DNA, 22 bp, Artificial Sequence
  chemically synthesized
ctgcagtgcactttaggctgta

SEQ ID NO: 1405748 - DNA, 22 bp, Artificial Sequence
  chemically synthesized
gagctttggggttacagcctaa

SEQ ID NO: 1405749 - DNA, 22 bp, Artificial Sequence
  chemically synthesized
ttgagctttggggttacagcct

SEQ ID NO: 1405750 - DNA, 22 bp, Artificial Sequence
  chemically synthesized
cagtgcactttaggctgtaacc

SEQ ID NO: 1405751 - DNA, 22 bp, Artificial Sequence
  chemically synthesized
cttgagctttggggttacagcc

SEQ ID NO: 1405752 - DNA, 22 bp, Artificial Sequence
  chemically synthesized
tcttgagctttggggttacagc

SEQ ID NO: 1405753 - DNA, 22 bp, Artificial Sequence
  chemically synthesized
ttttcttgagctttggggttac

SEQ ID NO: 1405754 - DNA, 22 bp, Artificial Sequence
  chemically synthesized
attttcttgagctttggggtta

SEQ ID NO: 1405755 - DNA, 22 bp, Artificial Sequence
  chemically synthesized
taggctgtaaccccaaagctca

SEQ ID NO: 1405756 - DNA, 22 bp, Artificial Sequence
  chemically synthesized
aggctgtaaccccaaagctcaa

SEQ ID NO: 1405757 - DNA, 22 bp, Artificial Sequence
  chemically synthesized
ggctgtaaccccaaagctcaag

SEQ ID NO: 1405758 - DNA, 22 bp, Artificial Sequence
  chemically synthesized
caaaaaacttattttcttgagc

SEQ ID NO: 1405759 - DNA, 22 bp, Artificial Sequence
  chemically synthesized
ccaaaaaacttattttcttgag

SEQ ID NO: 1405760 - DNA, 22 bp, Artificial Sequence
  chemically synthesized
taaccccaaagctcaagaaaat

SEQ ID NO: 1405761 - DNA, 22 bp, Artificial Sequence
  chemically synthesized
gcttccaaaaaacttattttct

SEQ ID NO: 1405762 - DNA, 22 bp, Artificial Sequence
  chemically synthesized
acatgactggcttccaaaaaac

SEQ ID NO: 1405763 - DNA, 22 bp, Artificial Sequence
  chemically synthesized
aagaaaataagttttttggaag

SEQ ID NO: 1405764 - DNA, 22 bp, Artificial Sequence
  chemically synthesized
tatgcctaacatgactggcttc

SEQ ID NO: 1405765 - DNA, 22 bp, Artificial Sequence
  chemically synthesized
tttggaagccagtcatgttagg

SEQ ID NO: 1405766 - DNA, 22 bp, Artificial Sequence
  chemically synthesized
ttggaagccagtcatgttaggc

SEQ ID NO: 1405767 - DNA, 22 bp, Artificial Sequence
  chemically synthesized
tggaagccagtcatgttaggca

SEQ ID NO: 1405768 - DNA, 22 bp, Artificial Sequence
  chemically synthesized
ggaagccagtcatgttaggcat

SEQ ID NO: 1405769 - DNA, 22 bp, Artificial Sequence
  chemically synthesized
gaagccagtcatgttaggcata

SEQ ID NO: 1405770 - DNA, 22 bp, Artificial Sequence
  chemically synthesized
taaacatataaattatatgcct

SEQ ID NO: 1405771 - DNA, 22 bp, Artificial Sequence
  chemically synthesized
aattataaacatataaattata

SEQ ID NO: 1405772 - DNA, 22 bp, Artificial Sequence
  chemically synthesized
aaattataaacatataaattat

SEQ ID NO: 1405773 - DNA, 22 bp, Artificial Sequence
  chemically synthesized
ggcatataatttatatgtttat

SEQ ID NO: 1405774 - DNA, 22 bp, Artificial Sequence
  chemically synthesized
aaaagatgacttaaattataaa

SEQ ID NO: 1405775 - DNA, 22 bp, Artificial Sequence
  chemically synthesized
gaaaagatgacttaaattataa

SEQ ID NO: 1405776 - DNA, 22 bp, Artificial Sequence
  chemically synthesized
tgaaaagatgacttaaattata

SEQ ID NO: 1405777 - DNA, 22 bp, Artificial Sequence
  chemically synthesized
ttgaaaagatgacttaaattat

SEQ ID NO: 1405778 - DNA, 22 bp, Artificial Sequence
  chemically synthesized
cttttgaaaagatgacttaaat

SEQ ID NO: 1405779 - DNA, 22 bp, Artificial Sequence
  chemically synthesized
atatgtttataatttaagtcat

SEQ ID NO: 1405780 - DNA, 22 bp, Artificial Sequence
  chemically synthesized
tatgtttataatttaagtcatc

SEQ ID NO: 1405781 - DNA, 22 bp, Artificial Sequence
  chemically synthesized
ataatttaagtcatcttttcaa

SEQ ID NO: 1405782 - DNA, 22 bp, Artificial Sequence
  chemically synthesized
taatttaagtcatcttttcaaa

SEQ ID NO: 1405783 - DNA, 22 bp, Artificial Sequence
  chemically synthesized
aatatatatactacttttgaaa

SEQ ID NO: 1405784 - DNA, 22 bp, Artificial Sequence
  chemically synthesized
aagtcatcttttcaaaagtagt

SEQ ID NO: 1405785 - DNA, 22 bp, Artificial Sequence
  chemically synthesized
agtcatcttttcaaaagtagta

SEQ ID NO: 1405786 - DNA, 22 bp, Artificial Sequence
  chemically synthesized
aatattcaatatatatactact

SEQ ID NO: 1405787 - DNA, 22 bp, Artificial Sequence
  chemically synthesized
aaatattcaatatatatactac

SEQ ID NO: 1405788 - DNA, 22 bp, Artificial Sequence
  chemically synthesized
taaatattcaatatatatacta

SEQ ID NO: 1405789 - DNA, 22 bp, Artificial Sequence
  chemically synthesized
ttcaaaagtagtatatatattg

SEQ ID NO: 1405790 - DNA, 22 bp, Artificial Sequence
  chemically synthesized
tcaaaagtagtatatatattga

SEQ ID NO: 1405791 - DNA, 22 bp, Artificial Sequence
  chemically synthesized
caaaagtagtatatatattgaa

SEQ ID NO: 1405792 - DNA, 22 bp, Artificial Sequence
  chemically synthesized
aaaagtagtatatatattgaat

SEQ ID NO: 1405793 - DNA, 22 bp, Artificial Sequence
  chemically synthesized
aataaaacaagaatactttaaa

SEQ ID NO: 1405794 - DNA, 22 bp, Artificial Sequence
  chemically synthesized
aatatttaaagtattcttgttt

SEQ ID NO: 1405795 - DNA, 22 bp, Artificial Sequence
  chemically synthesized
aaagtattcttgttttattcag

SEQ ID NO: 1405796 - DNA, 22 bp, Artificial Sequence
  chemically synthesized
aagtattcttgttttattcaga

SEQ ID NO: 1405797 - DNA, 22 bp, Artificial Sequence
  chemically synthesized
caatataaaatgtgacatctga

SEQ ID NO: 1405798 - DNA, 22 bp, Artificial Sequence
  chemically synthesized
ttgttttattcagatgtcacat

SEQ ID NO: 1405799 - DNA, 22 bp, Artificial Sequence
  chemically synthesized
attgcaatataaaatgtgacat

SEQ ID NO: 1405800 - DNA, 22 bp, Artificial Sequence
  chemically synthesized
gttttattcagatgtcacattt

SEQ ID NO: 1405801 - DNA, 22 bp, Artificial Sequence
  chemically synthesized
ttttattcagatgtcacatttt

SEQ ID NO: 1405802 - DNA, 22 bp, Artificial Sequence
  chemically synthesized
tattcagatgtcacattttata

SEQ ID NO: 1405803 - DNA, 22 bp, Artificial Sequence
  chemically synthesized
attcagatgtcacattttatat

SEQ ID NO: 1405804 - DNA, 22 bp, Artificial Sequence
  chemically synthesized
ttcagatgtcacattttatatt

SEQ ID NO: 1405805 - DNA, 22 bp, Artificial Sequence
  chemically synthesized
tagatactaattgcaatataaa

SEQ ID NO: 1405806 - DNA, 22 bp, Artificial Sequence
  chemically synthesized
agatgtcacattttatattgca

SEQ ID NO: 1405807 - DNA, 22 bp, Artificial Sequence
  chemically synthesized
acctatagatactaattgcaat

SEQ ID NO: 1405808 - DNA, 22 bp, Artificial Sequence
  chemically synthesized
gacctatagatactaattgcaa

SEQ ID NO: 1405809 - DNA, 22 bp, Artificial Sequence
  chemically synthesized
tgacctatagatactaattgca

SEQ ID NO: 1405810 - DNA, 22 bp, Artificial Sequence
  chemically synthesized
tatattgcaattagtatctata

SEQ ID NO: 1405811 - DNA, 22 bp, Artificial Sequence
  chemically synthesized
atattgcaattagtatctatag

SEQ ID NO: 1405812 - DNA, 22 bp, Artificial Sequence
  chemically synthesized
tattgcaattagtatctatagg

SEQ ID NO: 1405813 - DNA, 22 bp, Artificial Sequence
  chemically synthesized
catacattttgacctatagata

SEQ ID NO: 1405814 - DNA, 22 bp, Artificial Sequence
  chemically synthesized
caattagtatctataggtcaaa

SEQ ID NO: 1405815 - DNA, 22 bp, Artificial Sequence
  chemically synthesized
taactccatacattttgaccta

SEQ ID NO: 1405816 - DNA, 22 bp, Artificial Sequence
  chemically synthesized
ataactccatacattttgacct

SEQ ID NO: 1405817 - DNA, 22 bp, Artificial Sequence
  chemically synthesized
tataactccatacattttgacc

SEQ ID NO: 1405818 - DNA, 22 bp, Artificial Sequence
  chemically synthesized
ttataactccatacattttgac

SEQ ID NO: 1405819 - DNA, 22 bp, Artificial Sequence
  chemically synthesized
tttataactccatacattttga

SEQ ID NO: 1405820 - DNA, 22 bp, Artificial Sequence
  chemically synthesized
gtatctataggtcaaaatgtat

SEQ ID NO: 1405821 - DNA, 22 bp, Artificial Sequence
  chemically synthesized
ttttataactccatacattttg

SEQ ID NO: 1405822 - DNA, 22 bp, Artificial Sequence
  chemically synthesized
taggtcaaaatgtatggagtta

SEQ ID NO: 1405823 - DNA, 22 bp, Artificial Sequence
  chemically synthesized
aagaaaaccttttttataactc

SEQ ID NO: 1405824 - DNA, 22 bp, Artificial Sequence
  chemically synthesized
aaagaaaaccttttttataact

SEQ ID NO: 1405825 - DNA, 22 bp, Artificial Sequence
  chemically synthesized
taaagaaaaccttttttataac

SEQ ID NO: 1405826 - DNA, 22 bp, Artificial Sequence
  chemically synthesized
ttaaagaaaaccttttttataa

SEQ ID NO: 1405827 - DNA, 22 bp, Artificial Sequence
  chemically synthesized
tttaaagaaaaccttttttata

SEQ ID NO: 1405828 - DNA, 22 bp, Artificial Sequence
  chemically synthesized
gaaagcaaattttttaaagaaa

SEQ ID NO: 1405829 - DNA, 22 bp, Artificial Sequence
  chemically synthesized
taaaaaaggttttctttaaaaa

SEQ ID NO: 1405830 - DNA, 22 bp, Artificial Sequence
  chemically synthesized
atagtgttggaaagcaaatttt

SEQ ID NO: 1405831 - DNA, 22 bp, Artificial Sequence
  chemically synthesized
gatagtgttggaaagcaaattt

SEQ ID NO: 1405832 - DNA, 22 bp, Artificial Sequence
  chemically synthesized
tgatagtgttggaaagcaaatt

SEQ ID NO: 1405833 - DNA, 22 bp, Artificial Sequence
  chemically synthesized
tctttaaaaaatttgctttcca

SEQ ID NO: 1405834 - DNA, 22 bp, Artificial Sequence
  chemically synthesized
ctttgatagtgttggaaagcaa

SEQ ID NO: 1405835 - DNA, 22 bp, Artificial Sequence
  chemically synthesized
ctttaaaaaatttgctttccaa

SEQ ID NO: 1405836 - DNA, 22 bp, Artificial Sequence
  chemically synthesized
tttaaaaaatttgctttccaac

SEQ ID NO: 1405837 - DNA, 22 bp, Artificial Sequence
  chemically synthesized
taaaaaatttgctttccaacac

SEQ ID NO: 1405838 - DNA, 22 bp, Artificial Sequence
  chemically synthesized
aaaaaatttgctttccaacact

SEQ ID NO: 1405839 - DNA, 22 bp, Artificial Sequence
  chemically synthesized
aaaaatttgctttccaacacta

SEQ ID NO: 1405840 - DNA, 22 bp, Artificial Sequence
  chemically synthesized
agtgtctcctttgatagtgttg

SEQ ID NO: 1405841 - DNA, 22 bp, Artificial Sequence
  chemically synthesized
cagtgtctcctttgatagtgtt

SEQ ID NO: 1405842 - DNA, 22 bp, Artificial Sequence
  chemically synthesized
gctttccaacactatcaaagga

SEQ ID NO: 1405843 - DNA, 22 bp, Artificial Sequence
  chemically synthesized
ctttccaacactatcaaaggag

SEQ ID NO: 1405844 - DNA, 22 bp, Artificial Sequence
  chemically synthesized
taatgtttcagtgtctcctttg

SEQ ID NO: 1405845 - DNA, 22 bp, Artificial Sequence
  chemically synthesized
tccaacactatcaaaggagaca

SEQ ID NO: 1405846 - DNA, 22 bp, Artificial Sequence
  chemically synthesized
ccaacactatcaaaggagacac

SEQ ID NO: 1405847 - DNA, 22 bp, Artificial Sequence
  chemically synthesized
caacactatcaaaggagacact

SEQ ID NO: 1405848 - DNA, 22 bp, Artificial Sequence
  chemically synthesized
gctgtaatgtttcagtgtctcc

SEQ ID NO: 1405849 - DNA, 22 bp, Artificial Sequence
  chemically synthesized
aagttagctgtaatgtttcagt

SEQ ID NO: 1405850 - DNA, 22 bp, Artificial Sequence
  chemically synthesized
tcaaaggagacactgaaacatt

SEQ ID NO: 1405851 - DNA, 22 bp, Artificial Sequence
  chemically synthesized
aatgaaaaaactcaagttagct

SEQ ID NO: 1405852 - DNA, 22 bp, Artificial Sequence
  chemically synthesized
aaacattacagctaacttgagt

SEQ ID NO: 1405853 - DNA, 22 bp, Artificial Sequence
  chemically synthesized
aattaaatgaaaaaactcaagt

SEQ ID NO: 1405854 - DNA, 22 bp, Artificial Sequence
  chemically synthesized
aaattaaatgaaaaaactcaag

SEQ ID NO: 1405855 - DNA, 22 bp, Artificial Sequence
  chemically synthesized
taaattaaatgaaaaaactcaa

SEQ ID NO: 1405856 - DNA, 22 bp, Artificial Sequence
  chemically synthesized
cagctaacttgagttttttcat

SEQ ID NO: 1405857 - DNA, 22 bp, Artificial Sequence
  chemically synthesized
tctttaaattaaatgaaaaaac

SEQ ID NO: 1405858 - DNA, 22 bp, Artificial Sequence
  chemically synthesized
acttgagttttttcatttaatt

SEQ ID NO: 1405859 - DNA, 22 bp, Artificial Sequence
  chemically synthesized
acactatctttaaattaaatga

SEQ ID NO: 1405860 - DNA, 22 bp, Artificial Sequence
  chemically synthesized
ttcacactatctttaaattaaa

SEQ ID NO: 1405861 - DNA, 22 bp, Artificial Sequence
  chemically synthesized
gagttttttcatttaatttaaa

SEQ ID NO: 1405862 - DNA, 22 bp, Artificial Sequence
  chemically synthesized
agttttttcatttaatttaaag

SEQ ID NO: 1405863 - DNA, 22 bp, Artificial Sequence
  chemically synthesized
tttcatttaatttaaagatagt

SEQ ID NO: 1405864 - DNA, 22 bp, Artificial Sequence
  chemically synthesized
ttcatttaatttaaagatagtg

SEQ ID NO: 1405865 - DNA, 22 bp, Artificial Sequence
  chemically synthesized
agtacctgttcacactatcttt

SEQ ID NO: 1405866 - DNA, 22 bp, Artificial Sequence
  chemically synthesized
tcatttaatttaaagatagtgt

SEQ ID NO: 1405867 - DNA, 22 bp, Artificial Sequence
  chemically synthesized
cagtacctgttcacactatctt

SEQ ID NO: 1405868 - DNA, 22 bp, Artificial Sequence
  chemically synthesized
catttaatttaaagatagtgtg

SEQ ID NO: 1405869 - DNA, 22 bp, Artificial Sequence
  chemically synthesized
atttaatttaaagatagtgtga

SEQ ID NO: 1405870 - DNA, 22 bp, Artificial Sequence
  chemically synthesized
aatttaaagatagtgtgaacag

SEQ ID NO: 1405871 - DNA, 22 bp, Artificial Sequence
  chemically synthesized
atttaaagatagtgtgaacagg

SEQ ID NO: 1405872 - DNA, 22 bp, Artificial Sequence
  chemically synthesized
aaagatagtgtgaacaggtact

SEQ ID NO: 1405873 - DNA, 22 bp, Artificial Sequence
  chemically synthesized
aagatagtgtgaacaggtactg

SEQ ID NO: 1405874 - DNA, 22 bp, Artificial Sequence
  chemically synthesized
gtaaaatgtaagacagtgtctt

SEQ ID NO: 1405875 - DNA, 22 bp, Artificial Sequence
  chemically synthesized
tatagatattagtaaaatgtaa

SEQ ID NO: 1405876 - DNA, 22 bp, Artificial Sequence
  chemically synthesized
aagacactgtcttacattttac

SEQ ID NO: 1405877 - DNA, 22 bp, Artificial Sequence
  chemically synthesized
tatatagatattagtaaaatgt

SEQ ID NO: 1405878 - DNA, 22 bp, Artificial Sequence
  chemically synthesized
tcttacattttactaatatcta

SEQ ID NO: 1405879 - DNA, 22 bp, Artificial Sequence
  chemically synthesized
atccactctatatagatattag

SEQ ID NO: 1405880 - DNA, 22 bp, Artificial Sequence
  chemically synthesized
aatccactctatatagatatta

SEQ ID NO: 1405881 - DNA, 22 bp, Artificial Sequence
  chemically synthesized
acattttactaatatctatata

SEQ ID NO: 1405882 - DNA, 22 bp, Artificial Sequence
  chemically synthesized
cattttactaatatctatatag

SEQ ID NO: 1405883 - DNA, 22 bp, Artificial Sequence
  chemically synthesized
acaaatttaatccactctatat

SEQ ID NO: 1405884 - DNA, 22 bp, Artificial Sequence
  chemically synthesized
tactaatatctatatagagtgg

SEQ ID NO: 1405885 - DNA, 22 bp, Artificial Sequence
  chemically synthesized
cacaaatttaatccactctata

SEQ ID NO: 1405886 - DNA, 22 bp, Artificial Sequence
  chemically synthesized
actaatatctatatagagtgga

SEQ ID NO: 1405887 - DNA, 22 bp, Artificial Sequence
  chemically synthesized
tcacaaatttaatccactctat

SEQ ID NO: 1405888 - DNA, 22 bp, Artificial Sequence
  chemically synthesized
ctaatatctatatagagtggat

SEQ ID NO: 1405889 - DNA, 22 bp, Artificial Sequence
  chemically synthesized
atatctatatagagtggattaa

SEQ ID NO: 1405890 - DNA, 22 bp, Artificial Sequence
  chemically synthesized
tatagagtggattaaatttgtg

SEQ ID NO: 1405891 - DNA, 22 bp, Artificial Sequence
  chemically synthesized
tgcagatatatgttttcacaaa

SEQ ID NO: 1405892 - DNA, 22 bp, Artificial Sequence
  chemically synthesized
tgtgcagatatatgttttcaca

SEQ ID NO: 1405893 - DNA, 22 bp, Artificial Sequence
  chemically synthesized
tagactctgtgcagatatatgt

SEQ ID NO: 1405894 - DNA, 22 bp, Artificial Sequence
  chemically synthesized
aatttgtgaaaacatatatctg

SEQ ID NO: 1405895 - DNA, 22 bp, Artificial Sequence
  chemically synthesized
atagactctgtgcagatatatg

SEQ ID NO: 1405896 - DNA, 22 bp, Artificial Sequence
  chemically synthesized
gtgaaaacatatatctgcacag

SEQ ID NO: 1405897 - DNA, 22 bp, Artificial Sequence
  chemically synthesized
tgaaaacatatatctgcacaga

SEQ ID NO: 1405898 - DNA, 22 bp, Artificial Sequence
  chemically synthesized
agaaatttatagactctgtgca

SEQ ID NO: 1405899 - DNA, 22 bp, Artificial Sequence
  chemically synthesized
gagaaatttatagactctgtgc

SEQ ID NO: 1405900 - DNA, 22 bp, Artificial Sequence
  chemically synthesized
accttgagaaatttatagactc

SEQ ID NO: 1405901 - DNA, 22 bp, Artificial Sequence
  chemically synthesized
tgaccttgagaaatttatagac

SEQ ID NO: 1405902 - DNA, 22 bp, Artificial Sequence
  chemically synthesized
ctgaccttgagaaatttataga

SEQ ID NO: 1405903 - DNA, 22 bp, Artificial Sequence
  chemically synthesized
tctgaccttgagaaatttatag

SEQ ID NO: 1405904 - DNA, 22 bp, Artificial Sequence
  chemically synthesized
ttttctgaccttgagaaattta

SEQ ID NO: 1405905 - DNA, 22 bp, Artificial Sequence
  chemically synthesized
cacagagtctataaatttctca

SEQ ID NO: 1405906 - DNA, 22 bp, Artificial Sequence
  chemically synthesized
attttctgaccttgagaaattt

SEQ ID NO: 1405907 - DNA, 22 bp, Artificial Sequence
  chemically synthesized
tggtttattttctgaccttgag

SEQ ID NO: 1405908 - DNA, 22 bp, Artificial Sequence
  chemically synthesized
atggtttattttctgaccttga

SEQ ID NO: 1405909 - DNA, 22 bp, Artificial Sequence
  chemically synthesized
tatggtttattttctgaccttg

SEQ ID NO: 1405910 - DNA, 22 bp, Artificial Sequence
  chemically synthesized
ttatggtttattttctgacctt

SEQ ID NO: 1405911 - DNA, 22 bp, Artificial Sequence
  chemically synthesized
tttatggtttattttctgacct

SEQ ID NO: 1405912 - DNA, 22 bp, Artificial Sequence
  chemically synthesized
taaatttctcaaggtcagaaaa

SEQ ID NO: 1405913 - DNA, 22 bp, Artificial Sequence
  chemically synthesized
aatctttttatggtttattttc

SEQ ID NO: 1405914 - DNA, 22 bp, Artificial Sequence
  chemically synthesized
ctcaaggtcagaaaataaacca

SEQ ID NO: 1405915 - DNA, 22 bp, Artificial Sequence
  chemically synthesized
tcaaggtcagaaaataaaccat

SEQ ID NO: 1405916 - DNA, 22 bp, Artificial Sequence
  chemically synthesized
aaggtcagaaaataaaccataa

SEQ ID NO: 1405917 - DNA, 22 bp, Artificial Sequence
  chemically synthesized
gaggaattaaatctttttatgg

SEQ ID NO: 1405918 - DNA, 22 bp, Artificial Sequence
  chemically synthesized
agaggaattaaatctttttatg

SEQ ID NO: 1405919 - DNA, 22 bp, Artificial Sequence
  chemically synthesized
tagaggaattaaatctttttat

SEQ ID NO: 1405920 - DNA, 22 bp, Artificial Sequence
  chemically synthesized
aagctttagaggaattaaatct

SEQ ID NO: 1405921 - DNA, 22 bp, Artificial Sequence
  chemically synthesized
aaagctttagaggaattaaatc

SEQ ID NO: 1405922 - DNA, 22 bp, Artificial Sequence
  chemically synthesized
gcatgcttaaagctttagagga

SEQ ID NO: 1405923 - DNA, 22 bp, Artificial Sequence
  chemically synthesized
aattcctctaaagctttaagca

SEQ ID NO: 1405924 - DNA, 22 bp, Artificial Sequence
  chemically synthesized
attcctctaaagctttaagcat

SEQ ID NO: 1405925 - DNA, 22 bp, Artificial Sequence
  chemically synthesized
acaaatgttagcatgcttaaag

SEQ ID NO: 1405926 - DNA, 22 bp, Artificial Sequence
  chemically synthesized
ctctaaagctttaagcatgcta

SEQ ID NO: 1405927 - DNA, 22 bp, Artificial Sequence
  chemically synthesized
taaagctttaagcatgctaaca

SEQ ID NO: 1405928 - DNA, 22 bp, Artificial Sequence
  chemically synthesized
aagctttaagcatgctaacatt

SEQ ID NO: 1405929 - DNA, 22 bp, Artificial Sequence
  chemically synthesized
taagatcaagttaacaaatgtt

SEQ ID NO: 1405930 - DNA, 22 bp, Artificial Sequence
  chemically synthesized
ataagatcaagttaacaaatgt

SEQ ID NO: 1405931 - DNA, 22 bp, Artificial Sequence
  chemically synthesized
taagcatgctaacatttgttaa

SEQ ID NO: 1405932 - DNA, 22 bp, Artificial Sequence
  chemically synthesized
tataagatcaagttaacaaatg

SEQ ID NO: 1405933 - DNA, 22 bp, Artificial Sequence
  chemically synthesized
aagcatgctaacatttgttaac

SEQ ID NO: 1405934 - DNA, 22 bp, Artificial Sequence
  chemically synthesized
agcatgctaacatttgttaact

SEQ ID NO: 1405935 - DNA, 22 bp, Artificial Sequence
  chemically synthesized
acatttgttaacttgatcttat

SEQ ID NO: 1405936 - DNA, 22 bp, Artificial Sequence
  chemically synthesized
aaatgtcattttataagatcaa

SEQ ID NO: 1405937 - DNA, 22 bp, Artificial Sequence
  chemically synthesized
gttaacttgatcttataaaatg

SEQ ID NO: 1405938 - DNA, 22 bp, Artificial Sequence
  chemically synthesized
ttaacttgatcttataaaatga

SEQ ID NO: 1405939 - DNA, 22 bp, Artificial Sequence
  chemically synthesized
acttgatcttataaaatgacat

SEQ ID NO: 1405940 - DNA, 22 bp, Artificial Sequence
  chemically synthesized
gatcttataaaatgacatttga

SEQ ID NO: 1405941 - DNA, 22 bp, Artificial Sequence
  chemically synthesized
atcttataaaatgacatttgag

SEQ ID NO: 1405942 - DNA, 22 bp, Artificial Sequence
  chemically synthesized
gaagataaacacatctcaaatg

SEQ ID NO: 1405943 - DNA, 22 bp, Artificial Sequence
  chemically synthesized
ataaaatgacatttgagatgtg

SEQ ID NO: 1405944 - DNA, 22 bp, Artificial Sequence
  chemically synthesized
taaaatgacatttgagatgtgt

SEQ ID NO: 1405945 - DNA, 22 bp, Artificial Sequence
  chemically synthesized
ggttggaagataaacacatctc

SEQ ID NO: 1405946 - DNA, 22 bp, Artificial Sequence
  chemically synthesized
aggttggaagataaacacatct

SEQ ID NO: 1405947 - DNA, 22 bp, Artificial Sequence
  chemically synthesized
taggttggaagataaacacatc

SEQ ID NO: 1405948 - DNA, 22 bp, Artificial Sequence
  chemically synthesized
atattttaggttggaagataaa

SEQ ID NO: 1405949 - DNA, 22 bp, Artificial Sequence
  chemically synthesized
gagatgtgtttatcttccaacc

SEQ ID NO: 1405950 - DNA, 22 bp, Artificial Sequence
  chemically synthesized
agatgtgtttatcttccaacct

SEQ ID NO: 1405951 - DNA, 22 bp, Artificial Sequence
  chemically synthesized
atcaataaaaattaatatttta

SEQ ID NO: 1405952 - DNA, 22 bp, Artificial Sequence
  chemically synthesized
atcttccaacctaaaatattaa

SEQ ID NO: 1405953 - DNA, 22 bp, Artificial Sequence
  chemically synthesized
tcttccaacctaaaatattaat

SEQ ID NO: 1405954 - DNA, 22 bp, Artificial Sequence
  chemically synthesized
ccaacctaaaatattaattttt

SEQ ID NO: 1405955 - DNA, 22 bp, Artificial Sequence
  chemically synthesized
caacctaaaatattaattttta

SEQ ID NO: 1405956 - DNA, 22 bp, Artificial Sequence
  chemically synthesized
taacctgatcaataaaaattaa

SEQ ID NO: 1405957 - DNA, 22 bp, Artificial Sequence
  chemically synthesized
ataacctgatcaataaaaatta

SEQ ID NO: 1405958 - DNA, 22 bp, Artificial Sequence
  chemically synthesized
aaatattaatttttattgatca

SEQ ID NO: 1405959 - DNA, 22 bp, Artificial Sequence
  chemically synthesized
atttttattgatcaggttataa

SEQ ID NO: 1405960 - DNA, 22 bp, Artificial Sequence
  chemically synthesized
caagtaagcaaaaacttataac

SEQ ID NO: 1405961 - DNA, 22 bp, Artificial Sequence
  chemically synthesized
ttattgatcaggttataagttt

SEQ ID NO: 1405962 - DNA, 22 bp, Artificial Sequence
  chemically synthesized
tattgatcaggttataagtttt

SEQ ID NO: 1405963 - DNA, 22 bp, Artificial Sequence
  chemically synthesized
attgatcaggttataagttttt

SEQ ID NO: 1405964 - DNA, 22 bp, Artificial Sequence
  chemically synthesized
ttgcaagtaagcaaaaacttat

SEQ ID NO: 1405965 - DNA, 22 bp, Artificial Sequence
  chemically synthesized
ttgatcaggttataagtttttg

SEQ ID NO: 1405966 - DNA, 22 bp, Artificial Sequence
  chemically synthesized
atcaggttataagtttttgctt

SEQ ID NO: 1405967 - DNA, 22 bp, Artificial Sequence
  chemically synthesized
taagtttttgcttacttgcaat

SEQ ID NO: 1405968 - DNA, 22 bp, Artificial Sequence
  chemically synthesized
ttgcttacttgcaataacttta

SEQ ID NO: 1405969 - DNA, 22 bp, Artificial Sequence
  chemically synthesized
tgcttacttgcaataactttat

SEQ ID NO: 1405970 - DNA, 22 bp, Artificial Sequence
  chemically synthesized
gcttacttgcaataactttatt

SEQ ID NO: 1405971 - DNA, 22 bp, Artificial Sequence
  chemically synthesized
cttacttgcaataactttatta

SEQ ID NO: 1405972 - DNA, 22 bp, Artificial Sequence
  chemically synthesized
acttgcaataactttattattt

SEQ ID NO: 1405973 - DNA, 22 bp, Artificial Sequence
  chemically synthesized
cttgcaataactttattatttt

SEQ ID NO: 1405974 - DNA, 22 bp, Artificial Sequence
  chemically synthesized
gggtcaacagaaaaaataataa

SEQ ID NO: 1405975 - DNA, 22 bp, Artificial Sequence
  chemically synthesized
gcaataactttattattttttc

SEQ ID NO: 1405976 - DNA, 22 bp, Artificial Sequence
  chemically synthesized
caataactttattattttttct

SEQ ID NO: 1405977 - DNA, 22 bp, Artificial Sequence
  chemically synthesized
tatgttagggtcaacagaaaaa

SEQ ID NO: 1405978 - DNA, 22 bp, Artificial Sequence
  chemically synthesized
ttatatgttagggtcaacagaa

SEQ ID NO: 1405979 - DNA, 22 bp, Artificial Sequence
  chemically synthesized
gttatatgttagggtcaacaga

SEQ ID NO: 1405980 - DNA, 22 bp, Artificial Sequence
  chemically synthesized
tattattttttctgttgaccct

SEQ ID NO: 1405981 - DNA, 22 bp, Artificial Sequence
  chemically synthesized
attattttttctgttgacccta

SEQ ID NO: 1405982 - DNA, 22 bp, Artificial Sequence
  chemically synthesized
ttattttttctgttgaccctaa

SEQ ID NO: 1405983 - DNA, 22 bp, Artificial Sequence
  chemically synthesized
atttgttatatgttagggtcaa

SEQ ID NO: 1405984 - DNA, 22 bp, Artificial Sequence
  chemically synthesized
catttgttatatgttagggtca

SEQ ID NO: 1405985 - DNA, 22 bp, Artificial Sequence
  chemically synthesized
ttttttctgttgaccctaacat

SEQ ID NO: 1405986 - DNA, 22 bp, Artificial Sequence
  chemically synthesized
tttctgttgaccctaacatata

SEQ ID NO: 1405987 - DNA, 22 bp, Artificial Sequence
  chemically synthesized
ttctgttgaccctaacatataa

SEQ ID NO: 1405988 - DNA, 22 bp, Artificial Sequence
  chemically synthesized
tctgttgaccctaacatataac

SEQ ID NO: 1405989 - DNA, 22 bp, Artificial Sequence
  chemically synthesized
ctgttgaccctaacatataaca

SEQ ID NO: 1405990 - DNA, 22 bp, Artificial Sequence
  chemically synthesized
tgttgaccctaacatataacaa

SEQ ID NO: 1405991 - DNA, 22 bp, Artificial Sequence
  chemically synthesized
cacatgtcttcatttgttatat

SEQ ID NO: 1405992 - DNA, 22 bp, Artificial Sequence
  chemically synthesized
ttgaccctaacatataacaaat

SEQ ID NO: 1405993 - DNA, 22 bp, Artificial Sequence
  chemically synthesized
accctaacatataacaaatgaa

SEQ ID NO: 1405994 - DNA, 22 bp, Artificial Sequence
  chemically synthesized
tatctgcacatgtcttcatttg

SEQ ID NO: 1405995 - DNA, 22 bp, Artificial Sequence
  chemically synthesized
acatataacaaatgaagacatg

SEQ ID NO: 1405996 - DNA, 22 bp, Artificial Sequence
  chemically synthesized
acatgttatatctgcacatgtc

SEQ ID NO: 1405997 - DNA, 22 bp, Artificial Sequence
  chemically synthesized
aacatgttatatctgcacatgt

SEQ ID NO: 1405998 - DNA, 22 bp, Artificial Sequence
  chemically synthesized
ttaacatgttatatctgcacat

SEQ ID NO: 1405999 - DNA, 22 bp, Artificial Sequence
  chemically synthesized
cttaacatgttatatctgcaca

SEQ ID NO: 1406000 - DNA, 22 bp, Artificial Sequence
  chemically synthesized
tcttcttaacatgttatatctg

SEQ ID NO: 1406001 - DNA, 22 bp, Artificial Sequence
  chemically synthesized
atcttcttaacatgttatatct

SEQ ID NO: 1406002 - DNA, 22 bp, Artificial Sequence
  chemically synthesized
tttatcttcttaacatgttata

SEQ ID NO: 1406003 - DNA, 22 bp, Artificial Sequence
  chemically synthesized
atttatcttcttaacatgttat

SEQ ID NO: 1406004 - DNA, 22 bp, Artificial Sequence
  chemically synthesized
tatttatcttcttaacatgtta

SEQ ID NO: 1406005 - DNA, 22 bp, Artificial Sequence
  chemically synthesized
atgttttatttatcttcttaac

SEQ ID NO: 1406006 - DNA, 22 bp, Artificial Sequence
  chemically synthesized
acatgagtgttgatgttttatt

SEQ ID NO: 1406007 - DNA, 22 bp, Artificial Sequence
  chemically synthesized
agaagataaataaaacatcaac

SEQ ID NO: 1406008 - DNA, 22 bp, Artificial Sequence
  chemically synthesized
cagtgttaacatgagtgttgat

SEQ ID NO: 1406009 - DNA, 22 bp, Artificial Sequence
  chemically synthesized
gcagtgttaacatgagtgttga

SEQ ID NO: 1406010 - DNA, 22 bp, Artificial Sequence
  chemically synthesized
atgtgtatttgcagtgttaaca

SEQ ID NO: 1406011 - DNA, 22 bp, Artificial Sequence
  chemically synthesized
tcatgtgtatttgcagtgttaa

SEQ ID NO: 1406012 - DNA, 22 bp, Artificial Sequence
  chemically synthesized
atgttaacactgcaaatacaca

SEQ ID NO: 1406013 - DNA, 22 bp, Artificial Sequence
  chemically synthesized
gtataaagctctcatgtgtatt

SEQ ID NO: 1406014 - DNA, 22 bp, Artificial Sequence
  chemically synthesized
agtataaagctctcatgtgtat

SEQ ID NO: 1406015 - DNA, 22 bp, Artificial Sequence
  chemically synthesized
acactgcaaatacacatgagag

SEQ ID NO: 1406016 - DNA, 22 bp, Artificial Sequence
  chemically synthesized
caaatacacatgagagctttat

SEQ ID NO: 1406017 - DNA, 22 bp, Artificial Sequence
  chemically synthesized
tatactaagacggccatctcct

SEQ ID NO: 1406018 - DNA, 22 bp, Artificial Sequence
  chemically synthesized
atactaagacggccatctcctc

SEQ ID NO: 1406019 - DNA, 22 bp, Artificial Sequence
  chemically synthesized
tactaagacggccatctcctcc

SEQ ID NO: 1406020 - DNA, 22 bp, Artificial Sequence
  chemically synthesized
agacggccatctcctccctctg

SEQ ID NO: 1406021 - DNA, 22 bp, Artificial Sequence
  chemically synthesized
aggaaaatataagtcagaggga

SEQ ID NO: 1406022 - DNA, 22 bp, Artificial Sequence
  chemically synthesized
caggaaaatataagtcagaggg

SEQ ID NO: 1406023 - DNA, 22 bp, Artificial Sequence
  chemically synthesized
ctccctctgacttatattttcc

SEQ ID NO: 1406024 - DNA, 22 bp, Artificial Sequence
  chemically synthesized
cctctgacttatattttcctga

SEQ ID NO: 1406025 - DNA, 22 bp, Artificial Sequence
  chemically synthesized
tgtaaatgtccttcaggaaaat

SEQ ID NO: 1406026 - DNA, 22 bp, Artificial Sequence
  chemically synthesized
tgacttatattttcctgaagga

SEQ ID NO: 1406027 - DNA, 22 bp, Artificial Sequence
  chemically synthesized
tgctatgtaaatgtccttcagg

SEQ ID NO: 1406028 - DNA, 22 bp, Artificial Sequence
  chemically synthesized
acttatattttcctgaaggaca

SEQ ID NO: 1406029 - DNA, 22 bp, Artificial Sequence
  chemically synthesized
atgctatgtaaatgtccttcag

SEQ ID NO: 1406030 - DNA, 22 bp, Artificial Sequence
  chemically synthesized
atattttcctgaaggacattta

SEQ ID NO: 1406031 - DNA, 22 bp, Artificial Sequence
  chemically synthesized
tattttcctgaaggacatttac

SEQ ID NO: 1406032 - DNA, 22 bp, Artificial Sequence
  chemically synthesized
aaatatttatgctatgtaaatg

SEQ ID NO: 1406033 - DNA, 22 bp, Artificial Sequence
  chemically synthesized
aaaatatttatgctatgtaaat

SEQ ID NO: 1406034 - DNA, 22 bp, Artificial Sequence
  chemically synthesized
tcctgaaggacatttacatagc

SEQ ID NO: 1406035 - DNA, 22 bp, Artificial Sequence
  chemically synthesized
taaaatatttatgctatgtaaa

SEQ ID NO: 1406036 - DNA, 22 bp, Artificial Sequence
  chemically synthesized
cctgaaggacatttacatagca

SEQ ID NO: 1406037 - DNA, 22 bp, Artificial Sequence
  chemically synthesized
ctgaaggacatttacatagcat

SEQ ID NO: 1406038 - DNA, 22 bp, Artificial Sequence
  chemically synthesized
aaggacatttacatagcataaa

SEQ ID NO: 1406039 - DNA, 22 bp, Artificial Sequence
  chemically synthesized
acatagcataaatattttaaag

SEQ ID NO: 1406040 - DNA, 22 bp, Artificial Sequence
  chemically synthesized
catagcataaatattttaaaga

SEQ ID NO: 1406041 - DNA, 22 bp, Artificial Sequence
  chemically synthesized
aaggtgtcatcaaatagccaaa

SEQ ID NO: 1406042 - DNA, 22 bp, Artificial Sequence
  chemically synthesized
taaagacttttggctatttgat

SEQ ID NO: 1406043 - DNA, 22 bp, Artificial Sequence
  chemically synthesized
aaagacttttggctatttgatg

SEQ ID NO: 1406044 - DNA, 22 bp, Artificial Sequence
  chemically synthesized
aagacttttggctatttgatga

SEQ ID NO: 1406045 - DNA, 22 bp, Artificial Sequence
  chemically synthesized
ttggctatttgatgacaccttg

SEQ ID NO: 1406046 - DNA, 22 bp, Artificial Sequence
  chemically synthesized
aaagtatatgttcaaggtgtca

SEQ ID NO: 1406047 - DNA, 22 bp, Artificial Sequence
  chemically synthesized
tggctatttgatgacaccttga

SEQ ID NO: 1406048 - DNA, 22 bp, Artificial Sequence
  chemically synthesized
ggctatttgatgacaccttgaa

SEQ ID NO: 1406049 - DNA, 22 bp, Artificial Sequence
  chemically synthesized
gctatttgatgacaccttgaac

SEQ ID NO: 1406050 - DNA, 22 bp, Artificial Sequence
  chemically synthesized
gattcaaagtatatgttcaagg

SEQ ID NO: 1406051 - DNA, 22 bp, Artificial Sequence
  chemically synthesized
agattcaaagtatatgttcaag

SEQ ID NO: 1406052 - DNA, 22 bp, Artificial Sequence
  chemically synthesized
tttgatgacaccttgaacatat

SEQ ID NO: 1406053 - DNA, 22 bp, Artificial Sequence
  chemically synthesized
gatgacaccttgaacatatact

SEQ ID NO: 1406054 - DNA, 22 bp, Artificial Sequence
  chemically synthesized
ccttagattcaaagtatatgtt

SEQ ID NO: 1406055 - DNA, 22 bp, Artificial Sequence
  chemically synthesized
atgacaccttgaacatatactt

SEQ ID NO: 1406056 - DNA, 22 bp, Artificial Sequence
  chemically synthesized
cccttagattcaaagtatatgt

SEQ ID NO: 1406057 - DNA, 22 bp, Artificial Sequence
  chemically synthesized
tcccttagattcaaagtatatg

SEQ ID NO: 1406058 - DNA, 22 bp, Artificial Sequence
  chemically synthesized
ctttcccttagattcaaagtat

SEQ ID NO: 1406059 - DNA, 22 bp, Artificial Sequence
  chemically synthesized
tcctttcccttagattcaaagt

SEQ ID NO: 1406060 - DNA, 22 bp, Artificial Sequence
  chemically synthesized
gaacatatactttgaatctaag

SEQ ID NO: 1406061 - DNA, 22 bp, Artificial Sequence
  chemically synthesized
aacatatactttgaatctaagg

SEQ ID NO: 1406062 - DNA, 22 bp, Artificial Sequence
  chemically synthesized
tgaatctaagggaaaggagagt

SEQ ID NO: 1406063 - DNA, 22 bp, Artificial Sequence
  chemically synthesized
gaatctaagggaaaggagagtc

SEQ ID NO: 1406064 - DNA, 22 bp, Artificial Sequence
  chemically synthesized
aatctaagggaaaggagagtca

SEQ ID NO: 1406065 - DNA, 22 bp, Artificial Sequence
  chemically synthesized
gaaaggagataaatatgactct

SEQ ID NO: 1406066 - DNA, 22 bp, Artificial Sequence
  chemically synthesized
agaaaggagataaatatgactc

SEQ ID NO: 1406067 - DNA, 22 bp, Artificial Sequence
  chemically synthesized
tagaaaggagataaatatgact

SEQ ID NO: 1406068 - DNA, 22 bp, Artificial Sequence
  chemically synthesized
agggaaaggagagtcatattta

SEQ ID NO: 1406069 - DNA, 22 bp, Artificial Sequence
  chemically synthesized
ttttagaaaggagataaatatg

SEQ ID NO: 1406070 - DNA, 22 bp, Artificial Sequence
  chemically synthesized
aattgttttagaaaggagataa

SEQ ID NO: 1406071 - DNA, 22 bp, Artificial Sequence
  chemically synthesized
gaattgttttagaaaggagata

SEQ ID NO: 1406072 - DNA, 22 bp, Artificial Sequence
  chemically synthesized
atctcctttctaaaacaattca

SEQ ID NO: 1406073 - DNA, 22 bp, Artificial Sequence
  chemically synthesized
tctcctttctaaaacaattcaa

SEQ ID NO: 1406074 - DNA, 22 bp, Artificial Sequence
  chemically synthesized
ctttctaaaacaattcaaatgt

SEQ ID NO: 1406075 - DNA, 22 bp, Artificial Sequence
  chemically synthesized
tctaaaacaattcaaatgtgat

SEQ ID NO: 1406076 - DNA, 22 bp, Artificial Sequence
  chemically synthesized
ctaaaacaattcaaatgtgatg

SEQ ID NO: 1406077 - DNA, 22 bp, Artificial Sequence
  chemically synthesized
taaaacaattcaaatgtgatgt

SEQ ID NO: 1406078 - DNA, 22 bp, Artificial Sequence
  chemically synthesized
gcaaatagggacacatcacatt

SEQ ID NO: 1406079 - DNA, 22 bp, Artificial Sequence
  chemically synthesized
agcaaatagggacacatcacat

SEQ ID NO: 1406080 - DNA, 22 bp, Artificial Sequence
  chemically synthesized
aaacaattcaaatgtgatgtgt

SEQ ID NO: 1406081 - DNA, 22 bp, Artificial Sequence
  chemically synthesized
agcttagcaaatagggacacat

SEQ ID NO: 1406082 - DNA, 22 bp, Artificial Sequence
  chemically synthesized
cagcttagcaaatagggacaca

SEQ ID NO: 1406083 - DNA, 22 bp, Artificial Sequence
  chemically synthesized
tcagcttagcaaatagggacac

SEQ ID NO: 1406084 - DNA, 22 bp, Artificial Sequence
  chemically synthesized
aaatgtgatgtgtccctatttg

SEQ ID NO: 1406085 - DNA, 22 bp, Artificial Sequence
  chemically synthesized
ctttcagcttagcaaataggga

SEQ ID NO: 1406086 - DNA, 22 bp, Artificial Sequence
  chemically synthesized
actttcagcttagcaaataggg

SEQ ID NO: 1406087 - DNA, 22 bp, Artificial Sequence
  chemically synthesized
atcttactttcagcttagcaaa

SEQ ID NO: 1406088 - DNA, 22 bp, Artificial Sequence
  chemically synthesized
catcttactttcagcttagcaa

SEQ ID NO: 1406089 - DNA, 22 bp, Artificial Sequence
  chemically synthesized
acttcatcttactttcagctta

SEQ ID NO: 1406090 - DNA, 22 bp, Artificial Sequence
  chemically synthesized
gacttcatcttactttcagctt

SEQ ID NO: 1406091 - DNA, 22 bp, Artificial Sequence
  chemically synthesized
tttgacttcatcttactttcag

SEQ ID NO: 1406092 - DNA, 22 bp, Artificial Sequence
  chemically synthesized
atttgacttcatcttactttca

SEQ ID NO: 1406093 - DNA, 22 bp, Artificial Sequence
  chemically synthesized
tttgctaagctgaaagtaagat

SEQ ID NO: 1406094 - DNA, 22 bp, Artificial Sequence
  chemically synthesized
gctaagctgaaagtaagatgaa

SEQ ID NO: 1406095 - DNA, 22 bp, Artificial Sequence
  chemically synthesized
catttatttgacttcatcttac

SEQ ID NO: 1406096 - DNA, 22 bp, Artificial Sequence
  chemically synthesized
ctaagctgaaagtaagatgaag

SEQ ID NO: 1406097 - DNA, 22 bp, Artificial Sequence
  chemically synthesized
ccatttatttgacttcatctta

SEQ ID NO: 1406098 - DNA, 22 bp, Artificial Sequence
  chemically synthesized
tccatttatttgacttcatctt

SEQ ID NO: 1406099 - DNA, 22 bp, Artificial Sequence
  chemically synthesized
agctgaaagtaagatgaagtca

SEQ ID NO: 1406100 - DNA, 22 bp, Artificial Sequence
  chemically synthesized
attttccatttatttgacttca

SEQ ID NO: 1406101 - DNA, 22 bp, Artificial Sequence
  chemically synthesized
gattttccatttatttgacttc

SEQ ID NO: 1406102 - DNA, 22 bp, Artificial Sequence
  chemically synthesized
aaagtaagatgaagtcaaataa

SEQ ID NO: 1406103 - DNA, 22 bp, Artificial Sequence
  chemically synthesized
aaaatatttgattttccattta

SEQ ID NO: 1406104 - DNA, 22 bp, Artificial Sequence
  chemically synthesized
aaaaatatttgattttccattt

SEQ ID NO: 1406105 - DNA, 22 bp, Artificial Sequence
  chemically synthesized
gaagtttaaaaatatttgattt

SEQ ID NO: 1406106 - DNA, 22 bp, Artificial Sequence
  chemically synthesized
ctagaagtttaaaaatatttga

SEQ ID NO: 1406107 - DNA, 22 bp, Artificial Sequence
  chemically synthesized
ttaaacttctaggagctttttg

SEQ ID NO: 1406108 - DNA, 22 bp, Artificial Sequence
  chemically synthesized
taaacttctaggagctttttgt

SEQ ID NO: 1406109 - DNA, 22 bp, Artificial Sequence
  chemically synthesized
aaacttctaggagctttttgtt

SEQ ID NO: 1406110 - DNA, 22 bp, Artificial Sequence
  chemically synthesized
aacttctaggagctttttgttt

SEQ ID NO: 1406111 - DNA, 22 bp, Artificial Sequence
  chemically synthesized
aaataacaaaaaagcaaacaaa

SEQ ID NO: 1406112 - DNA, 22 bp, Artificial Sequence
  chemically synthesized
ctaggagctttttgtttgcttt

SEQ ID NO: 1406113 - DNA, 22 bp, Artificial Sequence
  chemically synthesized
taggagctttttgtttgctttt

SEQ ID NO: 1406114 - DNA, 22 bp, Artificial Sequence
  chemically synthesized
ttaaaataacaaaaaagcaaac

SEQ ID NO: 1406115 - DNA, 22 bp, Artificial Sequence
  chemically synthesized
attaaaataacaaaaaagcaaa

SEQ ID NO: 1406116 - DNA, 22 bp, Artificial Sequence
  chemically synthesized
ggagctttttgtttgctttttt

SEQ ID NO: 1406117 - DNA, 22 bp, Artificial Sequence
  chemically synthesized
ttattaaaataacaaaaaagca

SEQ ID NO: 1406118 - DNA, 22 bp, Artificial Sequence
  chemically synthesized
tcttattaaaataacaaaaaag

SEQ ID NO: 1406119 - DNA, 22 bp, Artificial Sequence
  chemically synthesized
ctcttattaaaataacaaaaaa

SEQ ID NO: 1406120 - DNA, 22 bp, Artificial Sequence
  chemically synthesized
tttgtttgcttttttgttattt

SEQ ID NO: 1406121 - DNA, 22 bp, Artificial Sequence
  chemically synthesized
tttctcttattaaaataacaaa

SEQ ID NO: 1406122 - DNA, 22 bp, Artificial Sequence
  chemically synthesized
ttgtttgcttttttgttatttt

SEQ ID NO: 1406123 - DNA, 22 bp, Artificial Sequence
  chemically synthesized
gtttctcttattaaaataacaa

SEQ ID NO: 1406124 - DNA, 22 bp, Artificial Sequence
  chemically synthesized
tgtttgcttttttgttatttta

SEQ ID NO: 1406125 - DNA, 22 bp, Artificial Sequence
  chemically synthesized
tgtttctcttattaaaataaca

SEQ ID NO: 1406126 - DNA, 22 bp, Artificial Sequence
  chemically synthesized
gtttgcttttttgttattttaa

SEQ ID NO: 1406127 - DNA, 22 bp, Artificial Sequence
  chemically synthesized
tttgcttttttgttattttaat

SEQ ID NO: 1406128 - DNA, 22 bp, Artificial Sequence
  chemically synthesized
ctttgtttctcttattaaaata

SEQ ID NO: 1406129 - DNA, 22 bp, Artificial Sequence
  chemically synthesized
actttgtttctcttattaaaat

SEQ ID NO: 1406130 - DNA, 22 bp, Artificial Sequence
  chemically synthesized
gcttttttgttattttaataag

SEQ ID NO: 1406131 - DNA, 22 bp, Artificial Sequence
  chemically synthesized
tactttgtttctcttattaaaa

SEQ ID NO: 1406132 - DNA, 22 bp, Artificial Sequence
  chemically synthesized
cttttttgttattttaataaga

SEQ ID NO: 1406133 - DNA, 22 bp, Artificial Sequence
  chemically synthesized
ttttgttattttaataagagaa

SEQ ID NO: 1406134 - DNA, 22 bp, Artificial Sequence
  chemically synthesized
tttgttattttaataagagaaa

SEQ ID NO: 1406135 - DNA, 22 bp, Artificial Sequence
  chemically synthesized
ttgttattttaataagagaaac

SEQ ID NO: 1406136 - DNA, 22 bp, Artificial Sequence
  chemically synthesized
tgttattttaataagagaaaca

SEQ ID NO: 1406137 - DNA, 22 bp, Artificial Sequence
  chemically synthesized
catgttttactttgtttctctt

SEQ ID NO: 1406138 - DNA, 22 bp, Artificial Sequence
  chemically synthesized
gttattttaataagagaaacaa

SEQ ID NO: 1406139 - DNA, 22 bp, Artificial Sequence
  chemically synthesized
acatgttttactttgtttctct

SEQ ID NO: 1406140 - DNA, 22 bp, Artificial Sequence
  chemically synthesized
ttattttaataagagaaacaaa

SEQ ID NO: 1406141 - DNA, 22 bp, Artificial Sequence
  chemically synthesized
tacatgttttactttgtttctc

SEQ ID NO: 1406142 - DNA, 22 bp, Artificial Sequence
  chemically synthesized
ttacatgttttactttgtttct

SEQ ID NO: 1406143 - DNA, 22 bp, Artificial Sequence
  chemically synthesized
ttttaataagagaaacaaagta

SEQ ID NO: 1406144 - DNA, 22 bp, Artificial Sequence
  chemically synthesized
taataagagaaacaaagtaaaa

SEQ ID NO: 1406145 - DNA, 22 bp, Artificial Sequence
  chemically synthesized
tgtttttacatgttttactttg

SEQ ID NO: 1406146 - DNA, 22 bp, Artificial Sequence
  chemically synthesized
aataagagaaacaaagtaaaac

SEQ ID NO: 1406147 - DNA, 22 bp, Artificial Sequence
  chemically synthesized
gtgtttttacatgttttacttt

SEQ ID NO: 1406148 - DNA, 22 bp, Artificial Sequence
  chemically synthesized
ataagagaaacaaagtaaaaca

SEQ ID NO: 1406149 - DNA, 22 bp, Artificial Sequence
  chemically synthesized
ggtgagagtttgtgtttttaca

SEQ ID NO: 1406150 - DNA, 22 bp, Artificial Sequence
  chemically synthesized
gtaagaggatgctgggtgagag

SEQ ID NO: 1406151 - DNA, 22 bp, Artificial Sequence
  chemically synthesized
cgtaagaggatgctgggtgaga

SEQ ID NO: 1406152 - DNA, 22 bp, Artificial Sequence
  chemically synthesized
ggtatttcgtaagaggatgctg

SEQ ID NO: 1406153 - DNA, 22 bp, Artificial Sequence
  chemically synthesized
tcacccagcatcctcttacgaa

SEQ ID NO: 1406154 - DNA, 22 bp, Artificial Sequence
  chemically synthesized
aaaattgggtatttcgtaagag

SEQ ID NO: 1406155 - DNA, 22 bp, Artificial Sequence
  chemically synthesized
gaaaattgggtatttcgtaaga

SEQ ID NO: 1406156 - DNA, 22 bp, Artificial Sequence
  chemically synthesized
acccagcatcctcttacgaaat

SEQ ID NO: 1406157 - DNA, 22 bp, Artificial Sequence
  chemically synthesized
tttgaaaattgggtatttcgta

SEQ ID NO: 1406158 - DNA, 22 bp, Artificial Sequence
  chemically synthesized
atttgaaaattgggtatttcgt

SEQ ID NO: 1406159 - DNA, 22 bp, Artificial Sequence
  chemically synthesized
cttatttgaaaattgggtattt

SEQ ID NO: 1406160 - DNA, 22 bp, Artificial Sequence
  chemically synthesized
ttacgaaatacccaattttcaa

SEQ ID NO: 1406161 - DNA, 22 bp, Artificial Sequence
  chemically synthesized
acgaaatacccaattttcaaat

SEQ ID NO: 1406162 - DNA, 22 bp, Artificial Sequence
  chemically synthesized
cgaaatacccaattttcaaata

SEQ ID NO: 1406163 - DNA, 22 bp, Artificial Sequence
  chemically synthesized
tcaaataagcagtactatttgc

SEQ ID NO: 1406164 - DNA, 22 bp, Artificial Sequence
  chemically synthesized
caaataagcagtactatttgct

SEQ ID NO: 1406165 - DNA, 22 bp, Artificial Sequence
  chemically synthesized
aaataagcagtactatttgctc

SEQ ID NO: 1406166 - DNA, 22 bp, Artificial Sequence
  chemically synthesized
aagaccagtaataaatagagca

SEQ ID NO: 1406167 - DNA, 22 bp, Artificial Sequence
  chemically synthesized
aaagaccagtaataaatagagc

SEQ ID NO: 1406168 - DNA, 22 bp, Artificial Sequence
  chemically synthesized
ttaaagaccagtaataaataga

SEQ ID NO: 1406169 - DNA, 22 bp, Artificial Sequence
  chemically synthesized
tcttaaagaccagtaataaata

SEQ ID NO: 1406170 - DNA, 22 bp, Artificial Sequence
  chemically synthesized
ctcttaaagaccagtaataaat

SEQ ID NO: 1406171 - DNA, 22 bp, Artificial Sequence
  chemically synthesized
tttctcttaaagaccagtaata

SEQ ID NO: 1406172 - DNA, 22 bp, Artificial Sequence
  chemically synthesized
tttgctctatttattactggtc

SEQ ID NO: 1406173 - DNA, 22 bp, Artificial Sequence
  chemically synthesized
gctctatttattactggtcttt

SEQ ID NO: 1406174 - DNA, 22 bp, Artificial Sequence
  chemically synthesized
ctctatttattactggtcttta

SEQ ID NO: 1406175 - DNA, 22 bp, Artificial Sequence
  chemically synthesized
ggtctatttctcttaaagacca

SEQ ID NO: 1406176 - DNA, 22 bp, Artificial Sequence
  chemically synthesized
aggtctatttctcttaaagacc

SEQ ID NO: 1406177 - DNA, 22 bp, Artificial Sequence
  chemically synthesized
tatttattactggtctttaaga

SEQ ID NO: 1406178 - DNA, 22 bp, Artificial Sequence
  chemically synthesized
taggtctatttctcttaaagac

SEQ ID NO: 1406179 - DNA, 22 bp, Artificial Sequence
  chemically synthesized
ttaggtctatttctcttaaaga

SEQ ID NO: 1406180 - DNA, 22 bp, Artificial Sequence
  chemically synthesized
tttattactggtctttaagaga

SEQ ID NO: 1406181 - DNA, 22 bp, Artificial Sequence
  chemically synthesized
tttaggtctatttctcttaaag

SEQ ID NO: 1406182 - DNA, 22 bp, Artificial Sequence
  chemically synthesized
ttttaggtctatttctcttaaa

SEQ ID NO: 1406183 - DNA, 22 bp, Artificial Sequence
  chemically synthesized
attactggtctttaagagaaat

SEQ ID NO: 1406184 - DNA, 22 bp, Artificial Sequence
  chemically synthesized
ttttttaggtctatttctctta

SEQ ID NO: 1406185 - DNA, 22 bp, Artificial Sequence
  chemically synthesized
ttactggtctttaagagaaata

SEQ ID NO: 1406186 - DNA, 22 bp, Artificial Sequence
  chemically synthesized
ctggtctttaagagaaatagac

SEQ ID NO: 1406187 - DNA, 22 bp, Artificial Sequence
  chemically synthesized
gtctttaagagaaatagaccta

SEQ ID NO: 1406188 - DNA, 22 bp, Artificial Sequence
  chemically synthesized
caagatgttcttttttaggtct

SEQ ID NO: 1406189 - DNA, 22 bp, Artificial Sequence
  chemically synthesized
ccaagatgttcttttttaggtc

SEQ ID NO: 1406190 - DNA, 22 bp, Artificial Sequence
  chemically synthesized
taagagaaatagacctaaaaaa

SEQ ID NO: 1406191 - DNA, 22 bp, Artificial Sequence
  chemically synthesized
aagagaaatagacctaaaaaag

SEQ ID NO: 1406192 - DNA, 22 bp, Artificial Sequence
  chemically synthesized
agagaaatagacctaaaaaaga

SEQ ID NO: 1406193 - DNA, 22 bp, Artificial Sequence
  chemically synthesized
gccttccaagatgttctttttt

SEQ ID NO: 1406194 - DNA, 22 bp, Artificial Sequence
  chemically synthesized
aaaaagaacatcttggaaggct

SEQ ID NO: 1406195 - DNA, 22 bp, Artificial Sequence
  chemically synthesized
tgaaagtacactagccttccaa

SEQ ID NO: 1406196 - DNA, 22 bp, Artificial Sequence
  chemically synthesized
agggaattatgaaagtacacta

SEQ ID NO: 1406197 - DNA, 22 bp, Artificial Sequence
  chemically synthesized
tcagggaattatgaaagtacac

SEQ ID NO: 1406198 - DNA, 22 bp, Artificial Sequence
  chemically synthesized
ctcagggaattatgaaagtaca

SEQ ID NO: 1406199 - DNA, 22 bp, Artificial Sequence
  chemically synthesized
ggaaggctagtgtactttcata

SEQ ID NO: 1406200 - DNA, 22 bp, Artificial Sequence
  chemically synthesized
gaaggctagtgtactttcataa

SEQ ID NO: 1406201 - DNA, 22 bp, Artificial Sequence
  chemically synthesized
agcttctcagggaattatgaaa

SEQ ID NO: 1406202 - DNA, 22 bp, Artificial Sequence
  chemically synthesized
gtgtactttcataattccctga

SEQ ID NO: 1406203 - DNA, 22 bp, Artificial Sequence
  chemically synthesized
ataatcactgagcttctcaggg

SEQ ID NO: 1406204 - DNA, 22 bp, Artificial Sequence
  chemically synthesized
ctcataatcactgagcttctca

SEQ ID NO: 1406205 - DNA, 22 bp, Artificial Sequence
  chemically synthesized
tcataattccctgagaagctca

SEQ ID NO: 1406206 - DNA, 22 bp, Artificial Sequence
  chemically synthesized
cataattccctgagaagctcag

SEQ ID NO: 1406207 - DNA, 22 bp, Artificial Sequence
  chemically synthesized
ataattccctgagaagctcagt

SEQ ID NO: 1406208 - DNA, 22 bp, Artificial Sequence
  chemically synthesized
acattactcataatcactgagc

SEQ ID NO: 1406209 - DNA, 22 bp, Artificial Sequence
  chemically synthesized
cctgagaagctcagtgattatg

SEQ ID NO: 1406210 - DNA, 22 bp, Artificial Sequence
  chemically synthesized
gttcacattactcataatcact

SEQ ID NO: 1406211 - DNA, 22 bp, Artificial Sequence
  chemically synthesized
tggttcacattactcataatca

SEQ ID NO: 1406212 - DNA, 22 bp, Artificial Sequence
  chemically synthesized
agaagctcagtgattatgagta

SEQ ID NO: 1406213 - DNA, 22 bp, Artificial Sequence
  chemically synthesized
aactctggttcacattactcat

SEQ ID NO: 1406214 - DNA, 22 bp, Artificial Sequence
  chemically synthesized
agtgattatgagtaatgtgaac

SEQ ID NO: 1406215 - DNA, 22 bp, Artificial Sequence
  chemically synthesized
tgagtaatgtgaaccagagttc

SEQ ID NO: 1406216 - DNA, 22 bp, Artificial Sequence
  chemically synthesized
caagggtaagaatattgaactc

SEQ ID NO: 1406217 - DNA, 22 bp, Artificial Sequence
  chemically synthesized
attccaagggtaagaatattga

SEQ ID NO: 1406218 - DNA, 22 bp, Artificial Sequence
  chemically synthesized
ctgattccaagggtaagaatat

SEQ ID NO: 1406219 - DNA, 22 bp, Artificial Sequence
  chemically synthesized
cctgattccaagggtaagaata

SEQ ID NO: 1406220 - DNA, 22 bp, Artificial Sequence
  chemically synthesized
tcctgattccaagggtaagaat

SEQ ID NO: 1406221 - DNA, 22 bp, Artificial Sequence
  chemically synthesized
ttcctgattccaagggtaagaa

SEQ ID NO: 1406222 - DNA, 22 bp, Artificial Sequence
  chemically synthesized
tttcctgattccaagggtaaga

SEQ ID NO: 1406223 - DNA, 22 bp, Artificial Sequence
  chemically synthesized
tttttcctgattccaagggtaa

SEQ ID NO: 1406224 - DNA, 22 bp, Artificial Sequence
  chemically synthesized
ctttttcctgattccaagggta

SEQ ID NO: 1406225 - DNA, 22 bp, Artificial Sequence
  chemically synthesized
tctttttcctgattccaagggt

SEQ ID NO: 1406226 - DNA, 22 bp, Artificial Sequence
  chemically synthesized
aatattcttacccttggaatca

SEQ ID NO: 1406227 - DNA, 22 bp, Artificial Sequence
  chemically synthesized
aaggactttctttttcctgatt

SEQ ID NO: 1406228 - DNA, 22 bp, Artificial Sequence
  chemically synthesized
aaaggactttctttttcctgat

SEQ ID NO: 1406229 - DNA, 22 bp, Artificial Sequence
  chemically synthesized
ttacccttggaatcaggaaaaa

SEQ ID NO: 1406230 - DNA, 22 bp, Artificial Sequence
  chemically synthesized
taaaggactttctttttcctga

SEQ ID NO: 1406231 - DNA, 22 bp, Artificial Sequence
  chemically synthesized
ttaaaggactttctttttcctg

SEQ ID NO: 1406232 - DNA, 22 bp, Artificial Sequence
  chemically synthesized
acccttggaatcaggaaaaaga

SEQ ID NO: 1406233 - DNA, 22 bp, Artificial Sequence
  chemically synthesized
cccttggaatcaggaaaaagaa

SEQ ID NO: 1406234 - DNA, 22 bp, Artificial Sequence
  chemically synthesized
atcttttaaaggactttctttt

SEQ ID NO: 1406235 - DNA, 22 bp, Artificial Sequence
  chemically synthesized
gatcttttaaaggactttcttt

SEQ ID NO: 1406236 - DNA, 22 bp, Artificial Sequence
  chemically synthesized
ggaatcaggaaaaagaaagtcc

SEQ ID NO: 1406237 - DNA, 22 bp, Artificial Sequence
  chemically synthesized
gaatcaggaaaaagaaagtcct

SEQ ID NO: 1406238 - DNA, 22 bp, Artificial Sequence
  chemically synthesized
tcaaagatcttgatcttttaaa

SEQ ID NO: 1406239 - DNA, 22 bp, Artificial Sequence
  chemically synthesized
ctatcaaagatcttgatctttt

SEQ ID NO: 1406240 - DNA, 22 bp, Artificial Sequence
  chemically synthesized
ctgctatcaaagatcttgatct

SEQ ID NO: 1406241 - DNA, 22 bp, Artificial Sequence
  chemically synthesized
ttactgctatcaaagatcttga

SEQ ID NO: 1406242 - DNA, 22 bp, Artificial Sequence
  chemically synthesized
gttactgctatcaaagatcttg

SEQ ID NO: 1406243 - DNA, 22 bp, Artificial Sequence
  chemically synthesized
ttgttactgctatcaaagatct

SEQ ID NO: 1406244 - DNA, 22 bp, Artificial Sequence
  chemically synthesized
taaaagatcaagatctttgata

SEQ ID NO: 1406245 - DNA, 22 bp, Artificial Sequence
  chemically synthesized
aaaagatcaagatctttgatag

SEQ ID NO: 1406246 - DNA, 22 bp, Artificial Sequence
  chemically synthesized
aaagatcaagatctttgatagc

SEQ ID NO: 1406247 - DNA, 22 bp, Artificial Sequence
  chemically synthesized
gttcttgttactgctatcaaag

SEQ ID NO: 1406248 - DNA, 22 bp, Artificial Sequence
  chemically synthesized
agttcttgttactgctatcaaa

SEQ ID NO: 1406249 - DNA, 22 bp, Artificial Sequence
  chemically synthesized
gcaaatttagttcttgttactg

SEQ ID NO: 1406250 - DNA, 22 bp, Artificial Sequence
  chemically synthesized
tgatagcagtaacaagaactaa

SEQ ID NO: 1406251 - DNA, 22 bp, Artificial Sequence
  chemically synthesized
cccctggcaaatttagttcttg

SEQ ID NO: 1406252 - DNA, 22 bp, Artificial Sequence
  chemically synthesized
gatagcagtaacaagaactaaa

SEQ ID NO: 1406253 - DNA, 22 bp, Artificial Sequence
  chemically synthesized
atagcagtaacaagaactaaat

SEQ ID NO: 1406254 - DNA, 22 bp, Artificial Sequence
  chemically synthesized
tacccctggcaaatttagttct

SEQ ID NO: 1406255 - DNA, 22 bp, Artificial Sequence
  chemically synthesized
gtaagaggacggctctacccct

SEQ ID NO: 1406256 - DNA, 22 bp, Artificial Sequence
  chemically synthesized
aatttgccaggggtagagccgt

SEQ ID NO: 1406257 - DNA, 22 bp, Artificial Sequence
  chemically synthesized
aaattggtaagaggacggctct

SEQ ID NO: 1406258 - DNA, 22 bp, Artificial Sequence
  chemically synthesized
gccaggggtagagccgtcctct

SEQ ID NO: 1406259 - DNA, 22 bp, Artificial Sequence
  chemically synthesized
ccaggggtagagccgtcctctt

SEQ ID NO: 1406260 - DNA, 22 bp, Artificial Sequence
  chemically synthesized
cctgaaattggtaagaggacgg

SEQ ID NO: 1406261 - DNA, 22 bp, Artificial Sequence
  chemically synthesized
gcctgaaattggtaagaggacg

SEQ ID NO: 1406262 - DNA, 22 bp, Artificial Sequence
  chemically synthesized
ttgcctgaaattggtaagagga

SEQ ID NO: 1406263 - DNA, 22 bp, Artificial Sequence
  chemically synthesized
cttgcctgaaattggtaagagg

SEQ ID NO: 1406264 - DNA, 22 bp, Artificial Sequence
  chemically synthesized
cttcttgcctgaaattggtaag

SEQ ID NO: 1406265 - DNA, 22 bp, Artificial Sequence
  chemically synthesized
aagaaaagattgcttcttgcct

SEQ ID NO: 1406266 - DNA, 22 bp, Artificial Sequence
  chemically synthesized
ttaccaatttcaggcaagaagc

SEQ ID NO: 1406267 - DNA, 22 bp, Artificial Sequence
  chemically synthesized
accaatttcaggcaagaagcaa

SEQ ID NO: 1406268 - DNA, 22 bp, Artificial Sequence
  chemically synthesized
ctcaagaaaagattgcttcttg

SEQ ID NO: 1406269 - DNA, 22 bp, Artificial Sequence
  chemically synthesized
ccaatttcaggcaagaagcaat

SEQ ID NO: 1406270 - DNA, 22 bp, Artificial Sequence
  chemically synthesized
gctactcaagaaaagattgctt

SEQ ID NO: 1406271 - DNA, 22 bp, Artificial Sequence
  chemically synthesized
cgctactcaagaaaagattgct

SEQ ID NO: 1406272 - DNA, 22 bp, Artificial Sequence
  chemically synthesized
tcgctactcaagaaaagattgc

SEQ ID NO: 1406273 - DNA, 22 bp, Artificial Sequence
  chemically synthesized
caggcaagaagcaatcttttct

SEQ ID NO: 1406274 - DNA, 22 bp, Artificial Sequence
  chemically synthesized
aggcaagaagcaatcttttctt

SEQ ID NO: 1406275 - DNA, 22 bp, Artificial Sequence
  chemically synthesized
cctttcgctactcaagaaaaga

SEQ ID NO: 1406276 - DNA, 22 bp, Artificial Sequence
  chemically synthesized
gcctttcgctactcaagaaaag

SEQ ID NO: 1406277 - DNA, 22 bp, Artificial Sequence
  chemically synthesized
gcttgcctttcgctactcaaga

SEQ ID NO: 1406278 - DNA, 22 bp, Artificial Sequence
  chemically synthesized
gttggcttgcctttcgctactc

SEQ ID NO: 1406279 - DNA, 22 bp, Artificial Sequence
  chemically synthesized
agttggcttgcctttcgctact

SEQ ID NO: 1406280 - DNA, 22 bp, Artificial Sequence
  chemically synthesized
tagttggcttgcctttcgctac

SEQ ID NO: 1406281 - DNA, 22 bp, Artificial Sequence
  chemically synthesized
tttagttggcttgcctttcgct

SEQ ID NO: 1406282 - DNA, 22 bp, Artificial Sequence
  chemically synthesized
ctttagttggcttgcctttcgc

SEQ ID NO: 1406283 - DNA, 22 bp, Artificial Sequence
  chemically synthesized
tctttagttggcttgcctttcg

SEQ ID NO: 1406284 - DNA, 22 bp, Artificial Sequence
  chemically synthesized
ttcttgagtagcgaaaggcaag

SEQ ID NO: 1406285 - DNA, 22 bp, Artificial Sequence
  chemically synthesized
ttctttagttggcttgcctttc

SEQ ID NO: 1406286 - DNA, 22 bp, Artificial Sequence
  chemically synthesized
tcttgagtagcgaaaggcaagc

SEQ ID NO: 1406287 - DNA, 22 bp, Artificial Sequence
  chemically synthesized
tttctttagttggcttgccttt

SEQ ID NO: 1406288 - DNA, 22 bp, Artificial Sequence
  chemically synthesized
cttgagtagcgaaaggcaagcc

SEQ ID NO: 1406289 - DNA, 22 bp, Artificial Sequence
  chemically synthesized
ttgagtagcgaaaggcaagcca

SEQ ID NO: 1406290 - DNA, 22 bp, Artificial Sequence
  chemically synthesized
gagtagcgaaaggcaagccaac

SEQ ID NO: 1406291 - DNA, 22 bp, Artificial Sequence
  chemically synthesized
agtagcgaaaggcaagccaact

SEQ ID NO: 1406292 - DNA, 22 bp, Artificial Sequence
  chemically synthesized
aagtcacacagattttttcttt

SEQ ID NO: 1406293 - DNA, 22 bp, Artificial Sequence
  chemically synthesized
tgtaattgaagtcacacagatt

SEQ ID NO: 1406294 - DNA, 22 bp, Artificial Sequence
  chemically synthesized
atgtaattgaagtcacacagat

SEQ ID NO: 1406295 - DNA, 22 bp, Artificial Sequence
  chemically synthesized
tatgtaattgaagtcacacaga

SEQ ID NO: 1406296 - DNA, 22 bp, Artificial Sequence
  chemically synthesized
aagaaaaaatctgtgtgacttc

SEQ ID NO: 1406297 - DNA, 22 bp, Artificial Sequence
  chemically synthesized
gtcaattttatgtaattgaagt

SEQ ID NO: 1406298 - DNA, 22 bp, Artificial Sequence
  chemically synthesized
tgtgacttcaattacataaaat

SEQ ID NO: 1406299 - DNA, 22 bp, Artificial Sequence
  chemically synthesized
accatctagtcaattttatgta

SEQ ID NO: 1406300 - DNA, 22 bp, Artificial Sequence
  chemically synthesized
aaccatctagtcaattttatgt

SEQ ID NO: 1406301 - DNA, 22 bp, Artificial Sequence
  chemically synthesized
taaccatctagtcaattttatg

SEQ ID NO: 1406302 - DNA, 22 bp, Artificial Sequence
  chemically synthesized
ttaaccatctagtcaattttat

SEQ ID NO: 1406303 - DNA, 22 bp, Artificial Sequence
  chemically synthesized
tttaaccatctagtcaatttta

SEQ ID NO: 1406304 - DNA, 22 bp, Artificial Sequence
  chemically synthesized
ttttttaaccatctagtcaatt

SEQ ID NO: 1406305 - DNA, 22 bp, Artificial Sequence
  chemically synthesized
caattacataaaattgactaga

SEQ ID NO: 1406306 - DNA, 22 bp, Artificial Sequence
  chemically synthesized
aattacataaaattgactagat

SEQ ID NO: 1406307 - DNA, 22 bp, Artificial Sequence
  chemically synthesized
cataaaattgactagatggtta

SEQ ID NO: 1406308 - DNA, 22 bp, Artificial Sequence
  chemically synthesized
tgaaagtattgttttttaacca

SEQ ID NO: 1406309 - DNA, 22 bp, Artificial Sequence
  chemically synthesized
tgtgaaagtattgttttttaac

SEQ ID NO: 1406310 - DNA, 22 bp, Artificial Sequence
  chemically synthesized
actagatggttaaaaaacaata

SEQ ID NO: 1406311 - DNA, 22 bp, Artificial Sequence
  chemically synthesized
gatggttaaaaaacaatacttt

SEQ ID NO: 1406312 - DNA, 22 bp, Artificial Sequence
  chemically synthesized
aaaaacaatactttcacagaat

SEQ ID NO: 1406313 - DNA, 22 bp, Artificial Sequence
  chemically synthesized
cagaaagaaaaaattctgtgaa

SEQ ID NO: 1406314 - DNA, 22 bp, Artificial Sequence
  chemically synthesized
acagaaagaaaaaattctgtga

SEQ ID NO: 1406315 - DNA, 22 bp, Artificial Sequence
  chemically synthesized
tacagaaagaaaaaattctgtg

SEQ ID NO: 1406316 - DNA, 22 bp, Artificial Sequence
  chemically synthesized
tcacagaattttttctttctgt

SEQ ID NO: 1406317 - DNA, 22 bp, Artificial Sequence
  chemically synthesized
cacagaattttttctttctgta

SEQ ID NO: 1406318 - DNA, 22 bp, Artificial Sequence
  chemically synthesized
acagaattttttctttctgtaa

SEQ ID NO: 1406319 - DNA, 22 bp, Artificial Sequence
  chemically synthesized
tttctttctgtaaaactttact

SEQ ID NO: 1406320 - DNA, 22 bp, Artificial Sequence
  chemically synthesized
ttctttctgtaaaactttactt

SEQ ID NO: 1406321 - DNA, 22 bp, Artificial Sequence
  chemically synthesized
tctttctgtaaaactttacttg

SEQ ID NO: 1406322 - DNA, 22 bp, Artificial Sequence
  chemically synthesized
ctttctgtaaaactttacttgt

SEQ ID NO: 1406323 - DNA, 22 bp, Artificial Sequence
  chemically synthesized
tttctgtaaaactttacttgta

SEQ ID NO: 1406324 - DNA, 22 bp, Artificial Sequence
  chemically synthesized
tctgtaaaactttacttgtatg

SEQ ID NO: 1406325 - DNA, 22 bp, Artificial Sequence
  chemically synthesized
ctgtaaaactttacttgtatgt

SEQ ID NO: 1406326 - DNA, 22 bp, Artificial Sequence
  chemically synthesized
tgtaaaactttacttgtatgtt

SEQ ID NO: 1406327 - DNA, 22 bp, Artificial Sequence
  chemically synthesized
taaaactttacttgtatgttgg

SEQ ID NO: 1406328 - DNA, 22 bp, Artificial Sequence
  chemically synthesized
aatgaaataagaaccaacatac

SEQ ID NO: 1406329 - DNA, 22 bp, Artificial Sequence
  chemically synthesized
tgaatgaaataagaaccaacat

SEQ ID NO: 1406330 - DNA, 22 bp, Artificial Sequence
  chemically synthesized
tacttgtatgttggttcttatt

SEQ ID NO: 1406331 - DNA, 22 bp, Artificial Sequence
  chemically synthesized
acttgtatgttggttcttattt

SEQ ID NO: 1406332 - DNA, 22 bp, Artificial Sequence
  chemically synthesized
cttgtatgttggttcttatttc

SEQ ID NO: 1406333 - DNA, 22 bp, Artificial Sequence
  chemically synthesized
atatatctctgaatgaaataag

SEQ ID NO: 1406334 - DNA, 22 bp, Artificial Sequence
  chemically synthesized
gtatgttggttcttatttcatt

SEQ ID NO: 1406335 - DNA, 22 bp, Artificial Sequence
  chemically synthesized
aatatatctctgaatgaaataa

SEQ ID NO: 1406336 - DNA, 22 bp, Artificial Sequence
  chemically synthesized
tatgttggttcttatttcattc

SEQ ID NO: 1406337 - DNA, 22 bp, Artificial Sequence
  chemically synthesized
ttaatatatctctgaatgaaat

SEQ ID NO: 1406338 - DNA, 22 bp, Artificial Sequence
  chemically synthesized
ctcttaatatatctctgaatga

SEQ ID NO: 1406339 - DNA, 22 bp, Artificial Sequence
  chemically synthesized
gctcttaatatatctctgaatg

SEQ ID NO: 1406340 - DNA, 22 bp, Artificial Sequence
  chemically synthesized
gttcttatttcattcagagata

SEQ ID NO: 1406341 - DNA, 22 bp, Artificial Sequence
  chemically synthesized
atttgctcttaatatatctctg

SEQ ID NO: 1406342 - DNA, 22 bp, Artificial Sequence
  chemically synthesized
catttgctcttaatatatctct

SEQ ID NO: 1406343 - DNA, 22 bp, Artificial Sequence
  chemically synthesized
ttatttcattcagagatatatt

SEQ ID NO: 1406344 - DNA, 22 bp, Artificial Sequence
  chemically synthesized
atttcattcagagatatattaa

SEQ ID NO: 1406345 - DNA, 22 bp, Artificial Sequence
  chemically synthesized
tttcattcagagatatattaag

SEQ ID NO: 1406346 - DNA, 22 bp, Artificial Sequence
  chemically synthesized
cattcagagatatattaagagc

SEQ ID NO: 1406347 - DNA, 22 bp, Artificial Sequence
  chemically synthesized
acaatttcatttgctcttaata

SEQ ID NO: 1406348 - DNA, 22 bp, Artificial Sequence
  chemically synthesized
attcagagatatattaagagca

SEQ ID NO: 1406349 - DNA, 22 bp, Artificial Sequence
  chemically synthesized
cacaatttcatttgctcttaat

SEQ ID NO: 1406350 - DNA, 22 bp, Artificial Sequence
  chemically synthesized
agagatatattaagagcaaatg

SEQ ID NO: 1406351 - DNA, 22 bp, Artificial Sequence
  chemically synthesized
aaaataatttcacaatttcatt

SEQ ID NO: 1406352 - DNA, 22 bp, Artificial Sequence
  chemically synthesized
gaaaataatttcacaatttcat

SEQ ID NO: 1406353 - DNA, 22 bp, Artificial Sequence
  chemically synthesized
agagcaaatgaaattgtgaaat

SEQ ID NO: 1406354 - DNA, 22 bp, Artificial Sequence
  chemically synthesized
tgtatttgaaaataatttcaca

SEQ ID NO: 1406355 - DNA, 22 bp, Artificial Sequence
  chemically synthesized
gtgtatttgaaaataatttcac

SEQ ID NO: 1406356 - DNA, 22 bp, Artificial Sequence
  chemically synthesized
tgtgtatttgaaaataatttca

SEQ ID NO: 1406357 - DNA, 22 bp, Artificial Sequence
  chemically synthesized
ttgtgtatttgaaaataatttc

SEQ ID NO: 1406358 - DNA, 22 bp, Artificial Sequence
  chemically synthesized
tttgtgtatttgaaaataattt

SEQ ID NO: 1406359 - DNA, 22 bp, Artificial Sequence
  chemically synthesized
ttttgtgtatttgaaaataatt

SEQ ID NO: 1406360 - DNA, 22 bp, Artificial Sequence
  chemically synthesized
tttttgtgtatttgaaaataat

SEQ ID NO: 1406361 - DNA, 22 bp, Artificial Sequence
  chemically synthesized
tgaaattattttcaaatacaca

SEQ ID NO: 1406362 - DNA, 22 bp, Artificial Sequence
  chemically synthesized
tcgtgggggagctttttttgtg

SEQ ID NO: 1406363 - DNA, 22 bp, Artificial Sequence
  chemically synthesized
ttttcaaatacacaaaaaaagc

SEQ ID NO: 1406364 - DNA, 22 bp, Artificial Sequence
  chemically synthesized
tcaaatacacaaaaaaagctcc

SEQ ID NO: 1406365 - DNA, 22 bp, Artificial Sequence
  chemically synthesized
caaatacacaaaaaaagctccc

SEQ ID NO: 1406366 - DNA, 22 bp, Artificial Sequence
  chemically synthesized
aaatacacaaaaaaagctcccc

SEQ ID NO: 1406367 - DNA, 22 bp, Artificial Sequence
  chemically synthesized
agaaaaagttgtcgtgggggag

SEQ ID NO: 1406368 - DNA, 22 bp, Artificial Sequence
  chemically synthesized
ccccacgacaactttttctcaa

SEQ ID NO: 1406369 - DNA, 22 bp, Artificial Sequence
  chemically synthesized
aggaaaggcaaaagaggcaatt

SEQ ID NO: 1406370 - DNA, 22 bp, Artificial Sequence
  chemically synthesized
tttctcaattgcctcttttgcc

SEQ ID NO: 1406371 - DNA, 22 bp, Artificial Sequence
  chemically synthesized
ttctcaattgcctcttttgcct

SEQ ID NO: 1406372 - DNA, 22 bp, Artificial Sequence
  chemically synthesized
tctcaattgcctcttttgcctt

SEQ ID NO: 1406373 - DNA, 22 bp, Artificial Sequence
  chemically synthesized
taaaactgaggaaaggcaaaag

SEQ ID NO: 1406374 - DNA, 22 bp, Artificial Sequence
  chemically synthesized
ctcaattgcctcttttgccttt

SEQ ID NO: 1406375 - DNA, 22 bp, Artificial Sequence
  chemically synthesized
tcaattgcctcttttgcctttc

SEQ ID NO: 1406376 - DNA, 22 bp, Artificial Sequence
  chemically synthesized
aattgcctcttttgcctttcct

SEQ ID NO: 1406377 - DNA, 22 bp, Artificial Sequence
  chemically synthesized
aagactataaaactgaggaaag

SEQ ID NO: 1406378 - DNA, 22 bp, Artificial Sequence
  chemically synthesized
cctcttttgcctttcctcagtt

SEQ ID NO: 1406379 - DNA, 22 bp, Artificial Sequence
  chemically synthesized
ttttgcctttcctcagttttat

SEQ ID NO: 1406380 - DNA, 22 bp, Artificial Sequence
  chemically synthesized
ttgcctttcctcagttttatag

SEQ ID NO: 1406381 - DNA, 22 bp, Artificial Sequence
  chemically synthesized
tgcctttcctcagttttatagt

SEQ ID NO: 1406382 - DNA, 22 bp, Artificial Sequence
  chemically synthesized
gcctttcctcagttttatagtc

SEQ ID NO: 1406383 - DNA, 22 bp, Artificial Sequence
  chemically synthesized
cctttcctcagttttatagtct

SEQ ID NO: 1406384 - DNA, 22 bp, Artificial Sequence
  chemically synthesized
tcctcagttttatagtcttcag

SEQ ID NO: 1406385 - DNA, 22 bp, Artificial Sequence
  chemically synthesized
cctcagttttatagtcttcagt

SEQ ID NO: 1406386 - DNA, 22 bp, Artificial Sequence
  chemically synthesized
ctcagttttatagtcttcagtg

SEQ ID NO: 1406387 - DNA, 22 bp, Artificial Sequence
  chemically synthesized
agttttatagtcttcagtgggt

SEQ ID NO: 1406388 - DNA, 22 bp, Artificial Sequence
  chemically synthesized
tatagtcttcagtgggtctccc

SEQ ID NO: 1406389 - DNA, 22 bp, Artificial Sequence
  chemically synthesized
atagtcttcagtgggtctccct

SEQ ID NO: 1406390 - DNA, 22 bp, Artificial Sequence
  chemically synthesized
tagtcttcagtgggtctccctc

SEQ ID NO: 1406391 - DNA, 22 bp, Artificial Sequence
  chemically synthesized
ggaatatggagcaatgagggag

SEQ ID NO: 1406392 - DNA, 22 bp, Artificial Sequence
  chemically synthesized
aggaatatggagcaatgaggga

SEQ ID NO: 1406393 - DNA, 22 bp, Artificial Sequence
  chemically synthesized
cagtgggtctccctcattgctc

SEQ ID NO: 1406394 - DNA, 22 bp, Artificial Sequence
  chemically synthesized
agtgggtctccctcattgctcc

SEQ ID NO: 1406395 - DNA, 22 bp, Artificial Sequence
  chemically synthesized
gcttaggaatatggagcaatga

SEQ ID NO: 1406396 - DNA, 22 bp, Artificial Sequence
  chemically synthesized
ttggcttaggaatatggagcaa

SEQ ID NO: 1406397 - DNA, 22 bp, Artificial Sequence
  chemically synthesized
ctgttggcttaggaatatggag

SEQ ID NO: 1406398 - DNA, 22 bp, Artificial Sequence
  chemically synthesized
cctgttggcttaggaatatgga

SEQ ID NO: 1406399 - DNA, 22 bp, Artificial Sequence
  chemically synthesized
ttcctgttggcttaggaatatg

SEQ ID NO: 1406400 - DNA, 22 bp, Artificial Sequence
  chemically synthesized
cctcattgctccatattcctaa

SEQ ID NO: 1406401 - DNA, 22 bp, Artificial Sequence
  chemically synthesized
attgctccatattcctaagcca

SEQ ID NO: 1406402 - DNA, 22 bp, Artificial Sequence
  chemically synthesized
ctccatattcctaagccaacag

SEQ ID NO: 1406403 - DNA, 22 bp, Artificial Sequence
  chemically synthesized
aaagaaattcttcctgttggct

SEQ ID NO: 1406404 - DNA, 22 bp, Artificial Sequence
  chemically synthesized
catattcctaagccaacaggaa

SEQ ID NO: 1406405 - DNA, 22 bp, Artificial Sequence
  chemically synthesized
agggtctgaaagaaattcttcc

SEQ ID NO: 1406406 - DNA, 22 bp, Artificial Sequence
  chemically synthesized
ctaagccaacaggaagaatttc

SEQ ID NO: 1406407 - DNA, 22 bp, Artificial Sequence
  chemically synthesized
aagggtctgaaagaaattcttc

SEQ ID NO: 1406408 - DNA, 22 bp, Artificial Sequence
  chemically synthesized
agccaacaggaagaatttcttt

SEQ ID NO: 1406409 - DNA, 22 bp, Artificial Sequence
  chemically synthesized
tggtaacagacacaaggcttaa

SEQ ID NO: 1406410 - DNA, 22 bp, Artificial Sequence
  chemically synthesized
ctttcagacccttaagccttgt

SEQ ID NO: 1406411 - DNA, 22 bp, Artificial Sequence
  chemically synthesized
tttcagacccttaagccttgtg

SEQ ID NO: 1406412 - DNA, 22 bp, Artificial Sequence
  chemically synthesized
tatggtaacagacacaaggctt

SEQ ID NO: 1406413 - DNA, 22 bp, Artificial Sequence
  chemically synthesized
tcagacccttaagccttgtgtc

SEQ ID NO: 1406414 - DNA, 22 bp, Artificial Sequence
  chemically synthesized
cagacccttaagccttgtgtct

SEQ ID NO: 1406415 - DNA, 22 bp, Artificial Sequence
  chemically synthesized
agacccttaagccttgtgtctg

SEQ ID NO: 1406416 - DNA, 22 bp, Artificial Sequence
  chemically synthesized
tctctatggtaacagacacaag

SEQ ID NO: 1406417 - DNA, 22 bp, Artificial Sequence
  chemically synthesized
aagccttgtgtctgttaccata

SEQ ID NO: 1406418 - DNA, 22 bp, Artificial Sequence
  chemically synthesized
agccttgtgtctgttaccatag

SEQ ID NO: 1406419 - DNA, 22 bp, Artificial Sequence
  chemically synthesized
tgatgcctgtctctatggtaac

SEQ ID NO: 1406420 - DNA, 22 bp, Artificial Sequence
  chemically synthesized
gtgatgcctgtctctatggtaa

SEQ ID NO: 1406421 - DNA, 22 bp, Artificial Sequence
  chemically synthesized
tgtgatgcctgtctctatggta

SEQ ID NO: 1406422 - DNA, 22 bp, Artificial Sequence
  chemically synthesized
ctttgtgatgcctgtctctatg

SEQ ID NO: 1406423 - DNA, 22 bp, Artificial Sequence
  chemically synthesized
gtgtctgttaccatagagacag

SEQ ID NO: 1406424 - DNA, 22 bp, Artificial Sequence
  chemically synthesized
tgtctgttaccatagagacagg

SEQ ID NO: 1406425 - DNA, 22 bp, Artificial Sequence
  chemically synthesized
ttaccatagagacaggcatcac

SEQ ID NO: 1406426 - DNA, 22 bp, Artificial Sequence
  chemically synthesized
agcagctactttgtgatgcctg

SEQ ID NO: 1406427 - DNA, 22 bp, Artificial Sequence
  chemically synthesized
ccatagagacaggcatcacaaa

SEQ ID NO: 1406428 - DNA, 22 bp, Artificial Sequence
  chemically synthesized
ctgagcagctactttgtgatgc

SEQ ID NO: 1406429 - DNA, 22 bp, Artificial Sequence
  chemically synthesized
catgaggatgttcctgagcagc

SEQ ID NO: 1406430 - DNA, 22 bp, Artificial Sequence
  chemically synthesized
ccatgaggatgttcctgagcag

SEQ ID NO: 1406431 - DNA, 22 bp, Artificial Sequence
  chemically synthesized
tatttccatgaggatgttcctg

SEQ ID NO: 1406432 - DNA, 22 bp, Artificial Sequence
  chemically synthesized
ttgtatttccatgaggatgttc

SEQ ID NO: 1406433 - DNA, 22 bp, Artificial Sequence
  chemically synthesized
attgtatttccatgaggatgtt

SEQ ID NO: 1406434 - DNA, 22 bp, Artificial Sequence
  chemically synthesized
ttattgtatttccatgaggatg

SEQ ID NO: 1406435 - DNA, 22 bp, Artificial Sequence
  chemically synthesized
ctcaggaacatcctcatggaaa

SEQ ID NO: 1406436 - DNA, 22 bp, Artificial Sequence
  chemically synthesized
aggaacatcctcatggaaatac

SEQ ID NO: 1406437 - DNA, 22 bp, Artificial Sequence
  chemically synthesized
taaaacccataggattcttatt

SEQ ID NO: 1406438 - DNA, 22 bp, Artificial Sequence
  chemically synthesized
atggaaatacaataagaatcct

SEQ ID NO: 1406439 - DNA, 22 bp, Artificial Sequence
  chemically synthesized
ctgtaaaacccataggattctt

SEQ ID NO: 1406440 - DNA, 22 bp, Artificial Sequence
  chemically synthesized
gaaattcctgtaaaacccatag

SEQ ID NO: 1406441 - DNA, 22 bp, Artificial Sequence
  chemically synthesized
gtagcgctggaaattcctgtaa

SEQ ID NO: 1406442 - DNA, 22 bp, Artificial Sequence
  chemically synthesized
actggtagcgctggaaattcct

SEQ ID NO: 1406443 - DNA, 22 bp, Artificial Sequence
  chemically synthesized
tgggttttacaggaatttccag

SEQ ID NO: 1406444 - DNA, 22 bp, Artificial Sequence
  chemically synthesized
ctcactggtagcgctggaaatt

SEQ ID NO: 1406445 - DNA, 22 bp, Artificial Sequence
  chemically synthesized
tgctcactggtagcgctggaaa

SEQ ID NO: 1406446 - DNA, 22 bp, Artificial Sequence
  chemically synthesized
ctgctcactggtagcgctggaa

SEQ ID NO: 1406447 - DNA, 22 bp, Artificial Sequence
  chemically synthesized
tacaggaatttccagcgctacc

SEQ ID NO: 1406448 - DNA, 22 bp, Artificial Sequence
  chemically synthesized
acaggaatttccagcgctacca

SEQ ID NO: 1406449 - DNA, 22 bp, Artificial Sequence
  chemically synthesized
caggaatttccagcgctaccag

SEQ ID NO: 1406450 - DNA, 22 bp, Artificial Sequence
  chemically synthesized
ccagcgctaccagtgagcagaa

SEQ ID NO: 1406451 - DNA, 22 bp, Artificial Sequence
  chemically synthesized
cagcgctaccagtgagcagaaa

SEQ ID NO: 1406452 - DNA, 22 bp, Artificial Sequence
  chemically synthesized
gggaaagatataatttctgctc

SEQ ID NO: 1406453 - DNA, 22 bp, Artificial Sequence
  chemically synthesized
tagggaaagatataatttctgc

SEQ ID NO: 1406454 - DNA, 22 bp, Artificial Sequence
  chemically synthesized
ctagggaaagatataatttctg

SEQ ID NO: 1406455 - DNA, 22 bp, Artificial Sequence
  chemically synthesized
tctagggaaagatataatttct

SEQ ID NO: 1406456 - DNA, 22 bp, Artificial Sequence
  chemically synthesized
ttctagggaaagatataatttc

SEQ ID NO: 1406457 - DNA, 22 bp, Artificial Sequence
  chemically synthesized
tttctagggaaagatataattt

SEQ ID NO: 1406458 - DNA, 22 bp, Artificial Sequence
  chemically synthesized
ccagtgagcagaaattatatct

SEQ ID NO: 1406459 - DNA, 22 bp, Artificial Sequence
  chemically synthesized
ttttctagggaaagatataatt

SEQ ID NO: 1406460 - DNA, 22 bp, Artificial Sequence
  chemically synthesized
tttttctagggaaagatataat

SEQ ID NO: 1406461 - DNA, 22 bp, Artificial Sequence
  chemically synthesized
aaatccccacattttttttcta

SEQ ID NO: 1406462 - DNA, 22 bp, Artificial Sequence
  chemically synthesized
tatctttccctagaaaaaaaat

SEQ ID NO: 1406463 - DNA, 22 bp, Artificial Sequence
  chemically synthesized
tccctagaaaaaaaatgtgggg

SEQ ID NO: 1406464 - DNA, 22 bp, Artificial Sequence
  chemically synthesized
ccctagaaaaaaaatgtgggga

SEQ ID NO: 1406465 - DNA, 22 bp, Artificial Sequence
  chemically synthesized
cctagaaaaaaaatgtggggat

SEQ ID NO: 1406466 - DNA, 22 bp, Artificial Sequence
  chemically synthesized
gaaaaaaaatgtggggatttta

SEQ ID NO: 1406467 - DNA, 22 bp, Artificial Sequence
  chemically synthesized
cataatgtgcaactaaaatccc

SEQ ID NO: 1406468 - DNA, 22 bp, Artificial Sequence
  chemically synthesized
catagttccataatgtgcaact

SEQ ID NO: 1406469 - DNA, 22 bp, Artificial Sequence
  chemically synthesized
caatctccatagttccataatg

SEQ ID NO: 1406470 - DNA, 22 bp, Artificial Sequence
  chemically synthesized
tagttgcacattatggaactat

SEQ ID NO: 1406471 - DNA, 22 bp, Artificial Sequence
  chemically synthesized
agttgcacattatggaactatg

SEQ ID NO: 1406472 - DNA, 22 bp, Artificial Sequence
  chemically synthesized
gttgcacattatggaactatgg

SEQ ID NO: 1406473 - DNA, 22 bp, Artificial Sequence
  chemically synthesized
cacattatggaactatggagat

SEQ ID NO: 1406474 - DNA, 22 bp, Artificial Sequence
  chemically synthesized
ccaccaaatattacaatctcca

SEQ ID NO: 1406475 - DNA, 22 bp, Artificial Sequence
  chemically synthesized
accaccaaatattacaatctcc

SEQ ID NO: 1406476 - DNA, 22 bp, Artificial Sequence
  chemically synthesized
tggaactatggagattgtaata

SEQ ID NO: 1406477 - DNA, 22 bp, Artificial Sequence
  chemically synthesized
aatttaccaccaaatattacaa

SEQ ID NO: 1406478 - DNA, 22 bp, Artificial Sequence
  chemically synthesized
tgaatttaccaccaaatattac

SEQ ID NO: 1406479 - DNA, 22 bp, Artificial Sequence
  chemically synthesized
tggagattgtaatatttggtgg

SEQ ID NO: 1406480 - DNA, 22 bp, Artificial Sequence
  chemically synthesized
agggattctgaatttaccacca

SEQ ID NO: 1406481 - DNA, 22 bp, Artificial Sequence
  chemically synthesized
taatatttggtggtaaattcag

SEQ ID NO: 1406482 - DNA, 22 bp, Artificial Sequence
  chemically synthesized
agcataaagctgagggattctg

SEQ ID NO: 1406483 - DNA, 22 bp, Artificial Sequence
  chemically synthesized
ggtggtaaattcagaatccctc

SEQ ID NO: 1406484 - DNA, 22 bp, Artificial Sequence
  chemically synthesized
gtggtaaattcagaatccctca

SEQ ID NO: 1406485 - DNA, 22 bp, Artificial Sequence
  chemically synthesized
taagcataaagctgagggattc

SEQ ID NO: 1406486 - DNA, 22 bp, Artificial Sequence
  chemically synthesized
agaatccctcagctttatgctt

SEQ ID NO: 1406487 - DNA, 22 bp, Artificial Sequence
  chemically synthesized
taatcaaattctaagcataaag

SEQ ID NO: 1406488 - DNA, 22 bp, Artificial Sequence
  chemically synthesized
agctttatgcttagaatttgat

SEQ ID NO: 1406489 - DNA, 22 bp, Artificial Sequence
  chemically synthesized
tatgcttagaatttgattatag

SEQ ID NO: 1406490 - DNA, 22 bp, Artificial Sequence
  chemically synthesized
atgcttagaatttgattatagt

SEQ ID NO: 1406491 - DNA, 22 bp, Artificial Sequence
  chemically synthesized
tgcttagaatttgattatagtt

SEQ ID NO: 1406492 - DNA, 22 bp, Artificial Sequence
  chemically synthesized
atgtcataggagaaactataat

SEQ ID NO: 1406493 - DNA, 22 bp, Artificial Sequence
  chemically synthesized
catgtcataggagaaactataa

SEQ ID NO: 1406494 - DNA, 22 bp, Artificial Sequence
  chemically synthesized
tcatgtcataggagaaactata

SEQ ID NO: 1406495 - DNA, 22 bp, Artificial Sequence
  chemically synthesized
ttcatgtcataggagaaactat

SEQ ID NO: 1406496 - DNA, 22 bp, Artificial Sequence
  chemically synthesized
agaatttgattatagtttctcc

SEQ ID NO: 1406497 - DNA, 22 bp, Artificial Sequence
  chemically synthesized
tttcatgtcataggagaaacta

SEQ ID NO: 1406498 - DNA, 22 bp, Artificial Sequence
  chemically synthesized
gaatttgattatagtttctcct

SEQ ID NO: 1406499 - DNA, 22 bp, Artificial Sequence
  chemically synthesized
ttttcatgtcataggagaaact

SEQ ID NO: 1406500 - DNA, 22 bp, Artificial Sequence
  chemically synthesized
tttttcatgtcataggagaaac

SEQ ID NO: 1406501 - DNA, 22 bp, Artificial Sequence
  chemically synthesized
gattatagtttctcctatgaca

SEQ ID NO: 1406502 - DNA, 22 bp, Artificial Sequence
  chemically synthesized
attatagtttctcctatgacat

SEQ ID NO: 1406503 - DNA, 22 bp, Artificial Sequence
  chemically synthesized
tagtttctcctatgacatgaaa

SEQ ID NO: 1406504 - DNA, 22 bp, Artificial Sequence
  chemically synthesized
ctcctatgacatgaaaaaaaat

SEQ ID NO: 1406505 - DNA, 22 bp, Artificial Sequence
  chemically synthesized
tcctatgacatgaaaaaaaatc

SEQ ID NO: 1406506 - DNA, 22 bp, Artificial Sequence
  chemically synthesized
ctatgacatgaaaaaaaatccc

SEQ ID NO: 1406507 - DNA, 22 bp, Artificial Sequence
  chemically synthesized
tgacatgaaaaaaaatcccttc

SEQ ID NO: 1406508 - DNA, 22 bp, Artificial Sequence
  chemically synthesized
aacatagggatatgagaaggga

SEQ ID NO: 1406509 - DNA, 22 bp, Artificial Sequence
  chemically synthesized
ctgaacatagggatatgagaag

SEQ ID NO: 1406510 - DNA, 22 bp, Artificial Sequence
  chemically synthesized
cctgaacatagggatatgagaa

SEQ ID NO: 1406511 - DNA, 22 bp, Artificial Sequence
  chemically synthesized
tcctgaacatagggatatgaga

SEQ ID NO: 1406512 - DNA, 22 bp, Artificial Sequence
  chemically synthesized
tattttcctgaacatagggata

SEQ ID NO: 1406513 - DNA, 22 bp, Artificial Sequence
  chemically synthesized
atattttcctgaacatagggat

SEQ ID NO: 1406514 - DNA, 22 bp, Artificial Sequence
  chemically synthesized
tttatattttcctgaacatagg

SEQ ID NO: 1406515 - DNA, 22 bp, Artificial Sequence
  chemically synthesized
ctcatatccctatgttcaggaa

SEQ ID NO: 1406516 - DNA, 22 bp, Artificial Sequence
  chemically synthesized
tcatatccctatgttcaggaaa

SEQ ID NO: 1406517 - DNA, 22 bp, Artificial Sequence
  chemically synthesized
atatccctatgttcaggaaaat

SEQ ID NO: 1406518 - DNA, 22 bp, Artificial Sequence
  chemically synthesized
gcaatgagttatttatattttc

SEQ ID NO: 1406519 - DNA, 22 bp, Artificial Sequence
  chemically synthesized
tgttcaggaaaatataaataac

SEQ ID NO: 1406520 - DNA, 22 bp, Artificial Sequence
  chemically synthesized
agaattagcaatgagttattta

SEQ ID NO: 1406521 - DNA, 22 bp, Artificial Sequence
  chemically synthesized
aagaattagcaatgagttattt

SEQ ID NO: 1406522 - DNA, 22 bp, Artificial Sequence
  chemically synthesized
aggaaaatataaataactcatt

SEQ ID NO: 1406523 - DNA, 22 bp, Artificial Sequence
  chemically synthesized
aatttaagaattagcaatgagt

SEQ ID NO: 1406524 - DNA, 22 bp, Artificial Sequence
  chemically synthesized
ataagacatgctaaatttaaga

SEQ ID NO: 1406525 - DNA, 22 bp, Artificial Sequence
  chemically synthesized
attgctaattcttaaatttagc

SEQ ID NO: 1406526 - DNA, 22 bp, Artificial Sequence
  chemically synthesized
ctaattcttaaatttagcatgt

SEQ ID NO: 1406527 - DNA, 22 bp, Artificial Sequence
  chemically synthesized
attcttaaatttagcatgtctt

SEQ ID NO: 1406528 - DNA, 22 bp, Artificial Sequence
  chemically synthesized
gtaaatgattgataagacatgc

SEQ ID NO: 1406529 - DNA, 22 bp, Artificial Sequence
  chemically synthesized
agtaaatgattgataagacatg

SEQ ID NO: 1406530 - DNA, 22 bp, Artificial Sequence
  chemically synthesized
tagtaaatgattgataagacat

SEQ ID NO: 1406531 - DNA, 22 bp, Artificial Sequence
  chemically synthesized
ttaaatttagcatgtcttatca

SEQ ID NO: 1406532 - DNA, 22 bp, Artificial Sequence
  chemically synthesized
aaatttagcatgtcttatcaat

SEQ ID NO: 1406533 - DNA, 22 bp, Artificial Sequence
  chemically synthesized
aatttagcatgtcttatcaatc

SEQ ID NO: 1406534 - DNA, 22 bp, Artificial Sequence
  chemically synthesized
agggttttagtaaatgattgat

SEQ ID NO: 1406535 - DNA, 22 bp, Artificial Sequence
  chemically synthesized
agcatgtcttatcaatcattta

SEQ ID NO: 1406536 - DNA, 22 bp, Artificial Sequence
  chemically synthesized
gcatgtcttatcaatcatttac

SEQ ID NO: 1406537 - DNA, 22 bp, Artificial Sequence
  chemically synthesized
atcaatcatttactaaaaccct

SEQ ID NO: 1406538 - DNA, 22 bp, Artificial Sequence
  chemically synthesized
tcaatcatttactaaaaccctt

SEQ ID NO: 1406539 - DNA, 22 bp, Artificial Sequence
  chemically synthesized
taaaagaacagttaagggtttt

SEQ ID NO: 1406540 - DNA, 22 bp, Artificial Sequence
  chemically synthesized
cactataaaagaacagttaagg

SEQ ID NO: 1406541 - DNA, 22 bp, Artificial Sequence
  chemically synthesized
actaaaacccttaactgttctt

SEQ ID NO: 1406542 - DNA, 22 bp, Artificial Sequence
  chemically synthesized
ctaaaacccttaactgttcttt

SEQ ID NO: 1406543 - DNA, 22 bp, Artificial Sequence
  chemically synthesized
aaacccttaactgttcttttat

SEQ ID NO: 1406544 - DNA, 22 bp, Artificial Sequence
  chemically synthesized
aactgttcttttatagtgcagt

SEQ ID NO: 1406545 - DNA, 22 bp, Artificial Sequence
  chemically synthesized
actgttcttttatagtgcagtg

SEQ ID NO: 1406546 - DNA, 22 bp, Artificial Sequence
  chemically synthesized
ttcttttatagtgcagtgcatt

SEQ ID NO: 1406547 - DNA, 22 bp, Artificial Sequence
  chemically synthesized
ttttatagtgcagtgcatttgt

SEQ ID NO: 1406548 - DNA, 22 bp, Artificial Sequence
  chemically synthesized
ttatagtgcagtgcatttgttt

SEQ ID NO: 1406549 - DNA, 22 bp, Artificial Sequence
  chemically synthesized
tatagtgcagtgcatttgtttt

SEQ ID NO: 1406550 - DNA, 22 bp, Artificial Sequence
  chemically synthesized
atagtgcagtgcatttgtttta

SEQ ID NO: 1406551 - DNA, 22 bp, Artificial Sequence
  chemically synthesized
tagtgcagtgcatttgttttat

SEQ ID NO: 1406552 - DNA, 22 bp, Artificial Sequence
  chemically synthesized
gaagggatcaagataaaacaaa

SEQ ID NO: 1406553 - DNA, 22 bp, Artificial Sequence
  chemically synthesized
tagaagggatcaagataaaaca

SEQ ID NO: 1406554 - DNA, 22 bp, Artificial Sequence
  chemically synthesized
gttttatcttgatcccttctag

SEQ ID NO: 1406555 - DNA, 22 bp, Artificial Sequence
  chemically synthesized
atcaaatatgttctagaaggga

SEQ ID NO: 1406556 - DNA, 22 bp, Artificial Sequence
  chemically synthesized
ttttatcttgatcccttctaga

SEQ ID NO: 1406557 - DNA, 22 bp, Artificial Sequence
  chemically synthesized
gatcaaatatgttctagaaggg

SEQ ID NO: 1406558 - DNA, 22 bp, Artificial Sequence
  chemically synthesized
ttgatcaaatatgttctagaag

SEQ ID NO: 1406559 - DNA, 22 bp, Artificial Sequence
  chemically synthesized
tatcttgatcccttctagaaca

SEQ ID NO: 1406560 - DNA, 22 bp, Artificial Sequence
  chemically synthesized
atcttgatcccttctagaacat

SEQ ID NO: 1406561 - DNA, 22 bp, Artificial Sequence
  chemically synthesized
tcttgatcccttctagaacata

SEQ ID NO: 1406562 - DNA, 22 bp, Artificial Sequence
  chemically synthesized
gatcccttctagaacatatttg

SEQ ID NO: 1406563 - DNA, 22 bp, Artificial Sequence
  chemically synthesized
atcccttctagaacatatttga

SEQ ID NO: 1406564 - DNA, 22 bp, Artificial Sequence
  chemically synthesized
tgagtgtgttcttgatcaaata

SEQ ID NO: 1406565 - DNA, 22 bp, Artificial Sequence
  chemically synthesized
ctagaacatatttgatcaagaa

SEQ ID NO: 1406566 - DNA, 22 bp, Artificial Sequence
  chemically synthesized
tagaacatatttgatcaagaac

SEQ ID NO: 1406567 - DNA, 22 bp, Artificial Sequence
  chemically synthesized
gaacatatttgatcaagaacac

SEQ ID NO: 1406568 - DNA, 22 bp, Artificial Sequence
  chemically synthesized
taacattatgagtgtgttcttg

SEQ ID NO: 1406569 - DNA, 22 bp, Artificial Sequence
  chemically synthesized
ataacattatgagtgtgttctt

SEQ ID NO: 1406570 - DNA, 22 bp, Artificial Sequence
  chemically synthesized
tataacattatgagtgtgttct

SEQ ID NO: 1406571 - DNA, 22 bp, Artificial Sequence
  chemically synthesized
ttataacattatgagtgtgttc

SEQ ID NO: 1406572 - DNA, 22 bp, Artificial Sequence
  chemically synthesized
cttttataacattatgagtgtg

SEQ ID NO: 1406573 - DNA, 22 bp, Artificial Sequence
  chemically synthesized
acttttataacattatgagtgt

SEQ ID NO: 1406574 - DNA, 22 bp, Artificial Sequence
  chemically synthesized
gatcaagaacacactcataatg

SEQ ID NO: 1406575 - DNA, 22 bp, Artificial Sequence
  chemically synthesized
atcaagaacacactcataatgt

SEQ ID NO: 1406576 - DNA, 22 bp, Artificial Sequence
  chemically synthesized
gagacttacttttataacatta

SEQ ID NO: 1406577 - DNA, 22 bp, Artificial Sequence
  chemically synthesized
agagacttacttttataacatt

SEQ ID NO: 1406578 - DNA, 22 bp, Artificial Sequence
  chemically synthesized
tagagacttacttttataacat

SEQ ID NO: 1406579 - DNA, 22 bp, Artificial Sequence
  chemically synthesized
cagttttagagacttactttta

SEQ ID NO: 1406580 - DNA, 22 bp, Artificial Sequence
  chemically synthesized
ataatgttataaaagtaagtct

SEQ ID NO: 1406581 - DNA, 22 bp, Artificial Sequence
  chemically synthesized
gaattgcagttttagagactta

SEQ ID NO: 1406582 - DNA, 22 bp, Artificial Sequence
  chemically synthesized
ggaattgcagttttagagactt

SEQ ID NO: 1406583 - DNA, 22 bp, Artificial Sequence
  chemically synthesized
tggaattgcagttttagagact

SEQ ID NO: 1406584 - DNA, 22 bp, Artificial Sequence
  chemically synthesized
taaaagtaagtctctaaaactg

SEQ ID NO: 1406585 - DNA, 22 bp, Artificial Sequence
  chemically synthesized
agcagctttggaattgcagttt

SEQ ID NO: 1406586 - DNA, 22 bp, Artificial Sequence
  chemically synthesized
tcagcagctttggaattgcagt

SEQ ID NO: 1406587 - DNA, 22 bp, Artificial Sequence
  chemically synthesized
tctcagcagctttggaattgca

SEQ ID NO: 1406588 - DNA, 22 bp, Artificial Sequence
  chemically synthesized
taaaactgcaattccaaagctg

SEQ ID NO: 1406589 - DNA, 22 bp, Artificial Sequence
  chemically synthesized
tagactctctcagcagctttgg

SEQ ID NO: 1406590 - DNA, 22 bp, Artificial Sequence
  chemically synthesized
aaactgcaattccaaagctgct

SEQ ID NO: 1406591 - DNA, 22 bp, Artificial Sequence
  chemically synthesized
atagactctctcagcagctttg

SEQ ID NO: 1406592 - DNA, 22 bp, Artificial Sequence
  chemically synthesized
caattccaaagctgctgagaga

SEQ ID NO: 1406593 - DNA, 22 bp, Artificial Sequence
  chemically synthesized
gtgggtttatagactctctcag

SEQ ID NO: 1406594 - DNA, 22 bp, Artificial Sequence
  chemically synthesized
cgtgggtttatagactctctca

SEQ ID NO: 1406595 - DNA, 22 bp, Artificial Sequence
  chemically synthesized
ttcgtgggtttatagactctct

SEQ ID NO: 1406596 - DNA, 22 bp, Artificial Sequence
  chemically synthesized
caaagctgctgagagagtctat

SEQ ID NO: 1406597 - DNA, 22 bp, Artificial Sequence
  chemically synthesized
tcttcgtgggtttatagactct

SEQ ID NO: 1406598 - DNA, 22 bp, Artificial Sequence
  chemically synthesized
tctcttcgtgggtttatagact

SEQ ID NO: 1406599 - DNA, 22 bp, Artificial Sequence
  chemically synthesized
ctctcttcgtgggtttatagac

SEQ ID NO: 1406600 - DNA, 22 bp, Artificial Sequence
  chemically synthesized
ttctctcttcgtgggtttatag

SEQ ID NO: 1406601 - DNA, 22 bp, Artificial Sequence
  chemically synthesized
ctgagagagtctataaacccac

SEQ ID NO: 1406602 - DNA, 22 bp, Artificial Sequence
  chemically synthesized
agagagtctataaacccacgaa

SEQ ID NO: 1406603 - DNA, 22 bp, Artificial Sequence
  chemically synthesized
ccctcttctctcttcgtgggtt

SEQ ID NO: 1406604 - DNA, 22 bp, Artificial Sequence
  chemically synthesized
cagctaccctcttctctcttcg

SEQ ID NO: 1406605 - DNA, 22 bp, Artificial Sequence
  chemically synthesized
gcagctaccctcttctctcttc

SEQ ID NO: 1406606 - DNA, 22 bp, Artificial Sequence
  chemically synthesized
ttgcagctaccctcttctctct

SEQ ID NO: 1406607 - DNA, 22 bp, Artificial Sequence
  chemically synthesized
taaacccacgaagagagaagag

SEQ ID NO: 1406608 - DNA, 22 bp, Artificial Sequence
  chemically synthesized
cttgcagctaccctcttctctc

SEQ ID NO: 1406609 - DNA, 22 bp, Artificial Sequence
  chemically synthesized
ttcttgcagctaccctcttctc

SEQ ID NO: 1406610 - DNA, 22 bp, Artificial Sequence
  chemically synthesized
cttcttgcagctaccctcttct

SEQ ID NO: 1406611 - DNA, 22 bp, Artificial Sequence
  chemically synthesized
tcttcttgcagctaccctcttc

SEQ ID NO: 1406612 - DNA, 22 bp, Artificial Sequence
  chemically synthesized
caagaagaaaattccactcact

SEQ ID NO: 1406613 - DNA, 22 bp, Artificial Sequence
  chemically synthesized
cactcactttaccttgttttcc

SEQ ID NO: 1406614 - DNA, 22 bp, Artificial Sequence
  chemically synthesized
actttaccttgttttccattga

SEQ ID NO: 1406615 - DNA, 22 bp, Artificial Sequence
  chemically synthesized
cagaaagggtgaaagtcaatgg

SEQ ID NO: 1406616 - DNA, 22 bp, Artificial Sequence
  chemically synthesized
taccttgttttccattgacttt

SEQ ID NO: 1406617 - DNA, 22 bp, Artificial Sequence
  chemically synthesized
acagaaagggtgaaagtcaatg

SEQ ID NO: 1406618 - DNA, 22 bp, Artificial Sequence
  chemically synthesized
accttgttttccattgactttc

SEQ ID NO: 1406619 - DNA, 22 bp, Artificial Sequence
  chemically synthesized
ccttgttttccattgactttca

SEQ ID NO: 1406620 - DNA, 22 bp, Artificial Sequence
  chemically synthesized
gttttccattgactttcaccct

SEQ ID NO: 1406621 - DNA, 22 bp, Artificial Sequence
  chemically synthesized
ttttccattgactttcaccctt

SEQ ID NO: 1406622 - DNA, 22 bp, Artificial Sequence
  chemically synthesized
agtagacttacagaaagggtga

SEQ ID NO: 1406623 - DNA, 22 bp, Artificial Sequence
  chemically synthesized
tccattgactttcaccctttct

SEQ ID NO: 1406624 - DNA, 22 bp, Artificial Sequence
  chemically synthesized
cagtagacttacagaaagggtg

SEQ ID NO: 1406625 - DNA, 22 bp, Artificial Sequence
  chemically synthesized
ccattgactttcaccctttctg

SEQ ID NO: 1406626 - DNA, 22 bp, Artificial Sequence
  chemically synthesized
cattgactttcaccctttctgt

SEQ ID NO: 1406627 - DNA, 22 bp, Artificial Sequence
  chemically synthesized
actttcaccctttctgtaagtc

SEQ ID NO: 1406628 - DNA, 22 bp, Artificial Sequence
  chemically synthesized
tcaccctttctgtaagtctact

SEQ ID NO: 1406629 - DNA, 22 bp, Artificial Sequence
  chemically synthesized
gtgtatgatttcagtagactta

SEQ ID NO: 1406630 - DNA, 22 bp, Artificial Sequence
  chemically synthesized
caccctttctgtaagtctactg

SEQ ID NO: 1406631 - DNA, 22 bp, Artificial Sequence
  chemically synthesized
accctttctgtaagtctactga

SEQ ID NO: 1406632 - DNA, 22 bp, Artificial Sequence
  chemically synthesized
cgttagtgtatgatttcagtag

SEQ ID NO: 1406633 - DNA, 22 bp, Artificial Sequence
  chemically synthesized
ccgttagtgtatgatttcagta

SEQ ID NO: 1406634 - DNA, 22 bp, Artificial Sequence
  chemically synthesized
tccgttagtgtatgatttcagt

SEQ ID NO: 1406635 - DNA, 22 bp, Artificial Sequence
  chemically synthesized
tctgtaagtctactgaaatcat

SEQ ID NO: 1406636 - DNA, 22 bp, Artificial Sequence
  chemically synthesized
ttccgttagtgtatgatttcag

SEQ ID NO: 1406637 - DNA, 22 bp, Artificial Sequence
  chemically synthesized
ctgtaagtctactgaaatcata

SEQ ID NO: 1406638 - DNA, 22 bp, Artificial Sequence
  chemically synthesized
tgtaagtctactgaaatcatac

SEQ ID NO: 1406639 - DNA, 22 bp, Artificial Sequence
  chemically synthesized
cttttccgttagtgtatgattt

SEQ ID NO: 1406640 - DNA, 22 bp, Artificial Sequence
  chemically synthesized
taagtctactgaaatcatacac

SEQ ID NO: 1406641 - DNA, 22 bp, Artificial Sequence
  chemically synthesized
ctgcttttccgttagtgtatga

SEQ ID NO: 1406642 - DNA, 22 bp, Artificial Sequence
  chemically synthesized
ttgctgcttttccgttagtgta

SEQ ID NO: 1406643 - DNA, 22 bp, Artificial Sequence
  chemically synthesized
attgctgcttttccgttagtgt

SEQ ID NO: 1406644 - DNA, 22 bp, Artificial Sequence
  chemically synthesized
tattgctgcttttccgttagtg

SEQ ID NO: 1406645 - DNA, 22 bp, Artificial Sequence
  chemically synthesized
ctgaaatcatacactaacggaa

SEQ ID NO: 1406646 - DNA, 22 bp, Artificial Sequence
  chemically synthesized
ttattgctgcttttccgttagt

SEQ ID NO: 1406647 - DNA, 22 bp, Artificial Sequence
  chemically synthesized
aaatcatacactaacggaaaag

SEQ ID NO: 1406648 - DNA, 22 bp, Artificial Sequence
  chemically synthesized
tttttattgctgcttttccgtt

SEQ ID NO: 1406649 - DNA, 22 bp, Artificial Sequence
  chemically synthesized
ttatttttattgctgcttttcc

SEQ ID NO: 1406650 - DNA, 22 bp, Artificial Sequence
  chemically synthesized
tgttatttttattgctgctttt

SEQ ID NO: 1406651 - DNA, 22 bp, Artificial Sequence
  chemically synthesized
acggaaaagcagcaataaaaat

SEQ ID NO: 1406652 - DNA, 22 bp, Artificial Sequence
  chemically synthesized
gtaggattctgttatttttatt

SEQ ID NO: 1406653 - DNA, 22 bp, Artificial Sequence
  chemically synthesized
ggtaggattctgttatttttat

SEQ ID NO: 1406654 - DNA, 22 bp, Artificial Sequence
  chemically synthesized
tttggtaggattctgttatttt

SEQ ID NO: 1406655 - DNA, 22 bp, Artificial Sequence
  chemically synthesized
cctatttggtaggattctgtta

SEQ ID NO: 1406656 - DNA, 22 bp, Artificial Sequence
  chemically synthesized
acctatttggtaggattctgtt

SEQ ID NO: 1406657 - DNA, 22 bp, Artificial Sequence
  chemically synthesized
aatttacctatttggtaggatt

SEQ ID NO: 1406658 - DNA, 22 bp, Artificial Sequence
  chemically synthesized
ctgaatttacctatttggtagg

SEQ ID NO: 1406659 - DNA, 22 bp, Artificial Sequence
  chemically synthesized
gctgaatttacctatttggtag

SEQ ID NO: 1406660 - DNA, 22 bp, Artificial Sequence
  chemically synthesized
atcttgctgaatttacctattt

SEQ ID NO: 1406661 - DNA, 22 bp, Artificial Sequence
  chemically synthesized
cattaatcttgctgaatttacc

SEQ ID NO: 1406662 - DNA, 22 bp, Artificial Sequence
  chemically synthesized
actccattaatcttgctgaatt

SEQ ID NO: 1406663 - DNA, 22 bp, Artificial Sequence
  chemically synthesized
ccaaataggtaaattcagcaag

SEQ ID NO: 1406664 - DNA, 22 bp, Artificial Sequence
  chemically synthesized
gactccattaatcttgctgaat

SEQ ID NO: 1406665 - DNA, 22 bp, Artificial Sequence
  chemically synthesized
gtttgactccattaatcttgct

SEQ ID NO: 1406666 - DNA, 22 bp, Artificial Sequence
  chemically synthesized
cctagtttgactccattaatct

SEQ ID NO: 1406667 - DNA, 22 bp, Artificial Sequence
  chemically synthesized
agcaagattaatggagtcaaac

SEQ ID NO: 1406668 - DNA, 22 bp, Artificial Sequence
  chemically synthesized
tatataatatctgcctagtttg

SEQ ID NO: 1406669 - DNA, 22 bp, Artificial Sequence
  chemically synthesized
atatataatatctgcctagttt

SEQ ID NO: 1406670 - DNA, 22 bp, Artificial Sequence
  chemically synthesized
atggagtcaaactaggcagata

SEQ ID NO: 1406671 - DNA, 22 bp, Artificial Sequence
  chemically synthesized
acttatatataatatctgccta

SEQ ID NO: 1406672 - DNA, 22 bp, Artificial Sequence
  chemically synthesized
caatcattgacttatatataat

SEQ ID NO: 1406673 - DNA, 22 bp, Artificial Sequence
  chemically synthesized
tgcaatcattgacttatatata

SEQ ID NO: 1406674 - DNA, 22 bp, Artificial Sequence
  chemically synthesized
ggcagatattatatataagtca

SEQ ID NO: 1406675 - DNA, 22 bp, Artificial Sequence
  chemically synthesized
aagtctctgcaatcattgactt

SEQ ID NO: 1406676 - DNA, 22 bp, Artificial Sequence
  chemically synthesized
tatataagtcaatgattgcaga

SEQ ID NO: 1406677 - DNA, 22 bp, Artificial Sequence
  chemically synthesized
cataaaaaattgaagtctctgc

SEQ ID NO: 1406678 - DNA, 22 bp, Artificial Sequence
  chemically synthesized
ccataaaaaattgaagtctctg

SEQ ID NO: 1406679 - DNA, 22 bp, Artificial Sequence
  chemically synthesized
atgtttccataaaaaattgaag

SEQ ID NO: 1406680 - DNA, 22 bp, Artificial Sequence
  chemically synthesized
aatgtttccataaaaaattgaa

SEQ ID NO: 1406681 - DNA, 22 bp, Artificial Sequence
  chemically synthesized
tttaatgtttccataaaaaatt

SEQ ID NO: 1406682 - DNA, 22 bp, Artificial Sequence
  chemically synthesized
atttaatgtttccataaaaaat

SEQ ID NO: 1406683 - DNA, 22 bp, Artificial Sequence
  chemically synthesized
cagagacttcaattttttatgg

SEQ ID NO: 1406684 - DNA, 22 bp, Artificial Sequence
  chemically synthesized
caattttttatggaaacattaa

SEQ ID NO: 1406685 - DNA, 22 bp, Artificial Sequence
  chemically synthesized
aggaatgtttatttaatgtttc

SEQ ID NO: 1406686 - DNA, 22 bp, Artificial Sequence
  chemically synthesized
aattttttatggaaacattaaa

SEQ ID NO: 1406687 - DNA, 22 bp, Artificial Sequence
  chemically synthesized
ttgaggaatgtttatttaatgt

SEQ ID NO: 1406688 - DNA, 22 bp, Artificial Sequence
  chemically synthesized
gttgaggaatgtttatttaatg

SEQ ID NO: 1406689 - DNA, 22 bp, Artificial Sequence
  chemically synthesized
tttatggaaacattaaataaac

SEQ ID NO: 1406690 - DNA, 22 bp, Artificial Sequence
  chemically synthesized
ttatggaaacattaaataaaca

SEQ ID NO: 1406691 - DNA, 22 bp, Artificial Sequence
  chemically synthesized
cttgttgaggaatgtttattta

SEQ ID NO: 1406692 - DNA, 22 bp, Artificial Sequence
  chemically synthesized
tatggaaacattaaataaacat

SEQ ID NO: 1406693 - DNA, 22 bp, Artificial Sequence
  chemically synthesized
acttgttgaggaatgtttattt

SEQ ID NO: 1406694 - DNA, 22 bp, Artificial Sequence
  chemically synthesized
atggaaacattaaataaacatt

SEQ ID NO: 1406695 - DNA, 22 bp, Artificial Sequence
  chemically synthesized
tggaaacattaaataaacattc

SEQ ID NO: 1406696 - DNA, 22 bp, Artificial Sequence
  chemically synthesized
agataatttacttgttgaggaa

SEQ ID NO: 1406697 - DNA, 22 bp, Artificial Sequence
  chemically synthesized
ttgagataatttacttgttgag

SEQ ID NO: 1406698 - DNA, 22 bp, Artificial Sequence
  chemically synthesized
aataaacattcctcaacaagta

SEQ ID NO: 1406699 - DNA, 22 bp, Artificial Sequence
  chemically synthesized
gtctattgagataatttacttg

SEQ ID NO: 1406700 - DNA, 22 bp, Artificial Sequence
  chemically synthesized
ttagtctattgagataatttac

SEQ ID NO: 1406701 - DNA, 22 bp, Artificial Sequence
  chemically synthesized
ctcaacaagtaaattatctcaa

SEQ ID NO: 1406702 - DNA, 22 bp, Artificial Sequence
  chemically synthesized
gctgttagtctattgagataat

SEQ ID NO: 1406703 - DNA, 22 bp, Artificial Sequence
  chemically synthesized
ggctgttagtctattgagataa

SEQ ID NO: 1406704 - DNA, 22 bp, Artificial Sequence
  chemically synthesized
aacaagtaaattatctcaatag

SEQ ID NO: 1406705 - DNA, 22 bp, Artificial Sequence
  chemically synthesized
atttggctgttagtctattgag

SEQ ID NO: 1406706 - DNA, 22 bp, Artificial Sequence
  chemically synthesized
catttggctgttagtctattga

SEQ ID NO: 1406707 - DNA, 22 bp, Artificial Sequence
  chemically synthesized
tctcaatagactaacagccaaa

SEQ ID NO: 1406708 - DNA, 22 bp, Artificial Sequence
  chemically synthesized
aatagactaacagccaaatgaa

SEQ ID NO: 1406709 - DNA, 22 bp, Artificial Sequence
  chemically synthesized
acagataaagatggtttcattt

SEQ ID NO: 1406710 - DNA, 22 bp, Artificial Sequence
  chemically synthesized
acagccaaatgaaaccatcttt

SEQ ID NO: 1406711 - DNA, 22 bp, Artificial Sequence
  chemically synthesized
aaatatgcagcctaacagataa

SEQ ID NO: 1406712 - DNA, 22 bp, Artificial Sequence
  chemically synthesized
gaaaagtagttcaaatatgcag

SEQ ID NO: 1406713 - DNA, 22 bp, Artificial Sequence
  chemically synthesized
tatctgttaggctgcatatttg

SEQ ID NO: 1406714 - DNA, 22 bp, Artificial Sequence
  chemically synthesized
ggaaaagtagttcaaatatgca

SEQ ID NO: 1406715 - DNA, 22 bp, Artificial Sequence
  chemically synthesized
atctgttaggctgcatatttga

SEQ ID NO: 1406716 - DNA, 22 bp, Artificial Sequence
  chemically synthesized
tctgttaggctgcatatttgaa

SEQ ID NO: 1406717 - DNA, 22 bp, Artificial Sequence
  chemically synthesized
ttaggctgcatatttgaactac

SEQ ID NO: 1406718 - DNA, 22 bp, Artificial Sequence
  chemically synthesized
gagacttggaaaagtagttcaa

SEQ ID NO: 1406719 - DNA, 22 bp, Artificial Sequence
  chemically synthesized
ggctgcatatttgaactacttt

SEQ ID NO: 1406720 - DNA, 22 bp, Artificial Sequence
  chemically synthesized
catatttgaactacttttccaa

SEQ ID NO: 1406721 - DNA, 22 bp, Artificial Sequence
  chemically synthesized
agtactagagacttggaaaagt

SEQ ID NO: 1406722 - DNA, 22 bp, Artificial Sequence
  chemically synthesized
aagtactagagacttggaaaag

SEQ ID NO: 1406723 - DNA, 22 bp, Artificial Sequence
  chemically synthesized
cttaagtactagagacttggaa

SEQ ID NO: 1406724 - DNA, 22 bp, Artificial Sequence
  chemically synthesized
gaactacttttccaagtctcta

SEQ ID NO: 1406725 - DNA, 22 bp, Artificial Sequence
  chemically synthesized
aactacttttccaagtctctag

SEQ ID NO: 1406726 - DNA, 22 bp, Artificial Sequence
  chemically synthesized
cttttccaagtctctagtactt

SEQ ID NO: 1406727 - DNA, 22 bp, Artificial Sequence
  chemically synthesized
ttccaagtctctagtacttaag

SEQ ID NO: 1406728 - DNA, 22 bp, Artificial Sequence
  chemically synthesized
tccaagtctctagtacttaagt

SEQ ID NO: 1406729 - DNA, 22 bp, Artificial Sequence
  chemically synthesized
ccaagtctctagtacttaagta

SEQ ID NO: 1406730 - DNA, 22 bp, Artificial Sequence
  chemically synthesized
caagtctctagtacttaagtag

SEQ ID NO: 1406731 - DNA, 22 bp, Artificial Sequence
  chemically synthesized
taaccacccatactacttaagt

SEQ ID NO: 1406732 - DNA, 22 bp, Artificial Sequence
  chemically synthesized
tagtacttaagtagtatgggtg

SEQ ID NO: 1406733 - DNA, 22 bp, Artificial Sequence
  chemically synthesized
gtacttaagtagtatgggtggt

SEQ ID NO: 1406734 - DNA, 22 bp, Artificial Sequence
  chemically synthesized
aagtagtatgggtggttacaat

SEQ ID NO: 1406735 - DNA, 22 bp, Artificial Sequence
  chemically synthesized
agtagtatgggtggttacaatt

SEQ ID NO: 1406736 - DNA, 22 bp, Artificial Sequence
  chemically synthesized
taccataaacagaaattgtaac

SEQ ID NO: 1406737 - DNA, 22 bp, Artificial Sequence
  chemically synthesized
tataccataaacagaaattgta

SEQ ID NO: 1406738 - DNA, 22 bp, Artificial Sequence
  chemically synthesized
aataacagttctataccataaa

SEQ ID NO: 1406739 - DNA, 22 bp, Artificial Sequence
  chemically synthesized
caatttctgtttatggtataga

SEQ ID NO: 1406740 - DNA, 22 bp, Artificial Sequence
  chemically synthesized
ctgtttatggtatagaactgtt

SEQ ID NO: 1406741 - DNA, 22 bp, Artificial Sequence
  chemically synthesized
tgtttatggtatagaactgtta

SEQ ID NO: 1406742 - DNA, 22 bp, Artificial Sequence
  chemically synthesized
tttatggtatagaactgttatt

SEQ ID NO: 1406743 - DNA, 22 bp, Artificial Sequence
  chemically synthesized
atggtatagaactgttatttaa

SEQ ID NO: 1406744 - DNA, 22 bp, Artificial Sequence
  chemically synthesized
tggtatagaactgttatttaac

SEQ ID NO: 1406745 - DNA, 22 bp, Artificial Sequence
  chemically synthesized
aacaagcaatgtaacagttaaa

SEQ ID NO: 1406746 - DNA, 22 bp, Artificial Sequence
  chemically synthesized
ttatttaactgttacattgctt

SEQ ID NO: 1406747 - DNA, 22 bp, Artificial Sequence
  chemically synthesized
aagtatctaaacaagcaatgta

SEQ ID NO: 1406748 - DNA, 22 bp, Artificial Sequence
  chemically synthesized
tttaactgttacattgcttgtt

SEQ ID NO: 1406749 - DNA, 22 bp, Artificial Sequence
  chemically synthesized
actcaagtatctaaacaagcaa

SEQ ID NO: 1406750 - DNA, 22 bp, Artificial Sequence
  chemically synthesized
aactgttacattgcttgtttag

SEQ ID NO: 1406751 - DNA, 22 bp, Artificial Sequence
  chemically synthesized
actgttacattgcttgtttaga

SEQ ID NO: 1406752 - DNA, 22 bp, Artificial Sequence
  chemically synthesized
ttgactcaagtatctaaacaag

SEQ ID NO: 1406753 - DNA, 22 bp, Artificial Sequence
  chemically synthesized
attgactcaagtatctaaacaa

SEQ ID NO: 1406754 - DNA, 22 bp, Artificial Sequence
  chemically synthesized
ttacattgcttgtttagatact

SEQ ID NO: 1406755 - DNA, 22 bp, Artificial Sequence
  chemically synthesized
cttattgactcaagtatctaaa

SEQ ID NO: 1406756 - DNA, 22 bp, Artificial Sequence
  chemically synthesized
gcttattgactcaagtatctaa

SEQ ID NO: 1406757 - DNA, 22 bp, Artificial Sequence
  chemically synthesized
tgcttattgactcaagtatcta

SEQ ID NO: 1406758 - DNA, 22 bp, Artificial Sequence
  chemically synthesized
cattgcttgtttagatacttga

SEQ ID NO: 1406759 - DNA, 22 bp, Artificial Sequence
  chemically synthesized
ttgcttattgactcaagtatct

SEQ ID NO: 1406760 - DNA, 22 bp, Artificial Sequence
  chemically synthesized
tttgcttattgactcaagtatc

SEQ ID NO: 1406761 - DNA, 22 bp, Artificial Sequence
  chemically synthesized
ttttttgcttattgactcaagt

SEQ ID NO: 1406762 - DNA, 22 bp, Artificial Sequence
  chemically synthesized
cttgtttagatacttgagtcaa

SEQ ID NO: 1406763 - DNA, 22 bp, Artificial Sequence
  chemically synthesized
gttttttgcttattgactcaag

SEQ ID NO: 1406764 - DNA, 22 bp, Artificial Sequence
  chemically synthesized
tgttttttgcttattgactcaa

SEQ ID NO: 1406765 - DNA, 22 bp, Artificial Sequence
  chemically synthesized
gtttagatacttgagtcaataa

SEQ ID NO: 1406766 - DNA, 22 bp, Artificial Sequence
  chemically synthesized
tttagatacttgagtcaataag

SEQ ID NO: 1406767 - DNA, 22 bp, Artificial Sequence
  chemically synthesized
agatacttgagtcaataagcaa

SEQ ID NO: 1406768 - DNA, 22 bp, Artificial Sequence
  chemically synthesized
gatacttgagtcaataagcaaa

SEQ ID NO: 1406769 - DNA, 22 bp, Artificial Sequence
  chemically synthesized
taaagaaattttgttttttgct

SEQ ID NO: 1406770 - DNA, 22 bp, Artificial Sequence
  chemically synthesized
gagtcaataagcaaaaaacaaa

SEQ ID NO: 1406771 - DNA, 22 bp, Artificial Sequence
  chemically synthesized
agtcaataagcaaaaaacaaaa

SEQ ID NO: 1406772 - DNA, 22 bp, Artificial Sequence
  chemically synthesized
gactataaagaaattttgtttt

SEQ ID NO: 1406773 - DNA, 22 bp, Artificial Sequence
  chemically synthesized
tagactataaagaaattttgtt

SEQ ID NO: 1406774 - DNA, 22 bp, Artificial Sequence
  chemically synthesized
atctctagactataaagaaatt

SEQ ID NO: 1406775 - DNA, 22 bp, Artificial Sequence
  chemically synthesized
acctcatctctagactataaag

SEQ ID NO: 1406776 - DNA, 22 bp, Artificial Sequence
  chemically synthesized
ctcacctcatctctagactata

SEQ ID NO: 1406777 - DNA, 22 bp, Artificial Sequence
  chemically synthesized
gctcacctcatctctagactat

SEQ ID NO: 1406778 - DNA, 22 bp, Artificial Sequence
  chemically synthesized
ctttatagtctagagatgaggt

SEQ ID NO: 1406779 - DNA, 22 bp, Artificial Sequence
  chemically synthesized
tttatagtctagagatgaggtg

SEQ ID NO: 1406780 - DNA, 22 bp, Artificial Sequence
  chemically synthesized
tatagtctagagatgaggtgag

SEQ ID NO: 1406781 - DNA, 22 bp, Artificial Sequence
  chemically synthesized
atagtctagagatgaggtgagc

SEQ ID NO: 1406782 - DNA, 22 bp, Artificial Sequence
  chemically synthesized
tagtctagagatgaggtgagca

SEQ ID NO: 1406783 - DNA, 22 bp, Artificial Sequence
  chemically synthesized
gataggaaaagtttgctcacct

SEQ ID NO: 1406784 - DNA, 22 bp, Artificial Sequence
  chemically synthesized
gagatgaggtgagcaaactttt

SEQ ID NO: 1406785 - DNA, 22 bp, Artificial Sequence
  chemically synthesized
gccctcgataggaaaagtttgc

SEQ ID NO: 1406786 - DNA, 22 bp, Artificial Sequence
  chemically synthesized
tctggccctcgataggaaaagt

SEQ ID NO: 1406787 - DNA, 22 bp, Artificial Sequence
  chemically synthesized
ctatctggccctcgataggaaa

SEQ ID NO: 1406788 - DNA, 22 bp, Artificial Sequence
  chemically synthesized
actatctggccctcgataggaa

SEQ ID NO: 1406789 - DNA, 22 bp, Artificial Sequence
  chemically synthesized
ttcctatcgagggccagatagt

SEQ ID NO: 1406790 - DNA, 22 bp, Artificial Sequence
  chemically synthesized
tcctatcgagggccagatagta

SEQ ID NO: 1406791 - DNA, 22 bp, Artificial Sequence
  chemically synthesized
cctatcgagggccagatagtaa

SEQ ID NO: 1406792 - DNA, 22 bp, Artificial Sequence
  chemically synthesized
ctatcgagggccagatagtaaa

SEQ ID NO: 1406793 - DNA, 22 bp, Artificial Sequence
  chemically synthesized
tcgagggccagatagtaaatat

SEQ ID NO: 1406794 - DNA, 22 bp, Artificial Sequence
  chemically synthesized
tgacagagaccatgtgggccac

SEQ ID NO: 1406795 - DNA, 22 bp, Artificial Sequence
  chemically synthesized
atgacagagaccatgtgggcca

SEQ ID NO: 1406796 - DNA, 22 bp, Artificial Sequence
  chemically synthesized
ctgctttgtggcccacatggtc

SEQ ID NO: 1406797 - DNA, 22 bp, Artificial Sequence
  chemically synthesized
ctttgtggcccacatggtctct

SEQ ID NO: 1406798 - DNA, 22 bp, Artificial Sequence
  chemically synthesized
agtacttatgacagagaccatg

SEQ ID NO: 1406799 - DNA, 22 bp, Artificial Sequence
  chemically synthesized
tgtggcccacatggtctctgtc

SEQ ID NO: 1406800 - DNA, 22 bp, Artificial Sequence
  chemically synthesized
gtggcccacatggtctctgtca

SEQ ID NO: 1406801 - DNA, 22 bp, Artificial Sequence
  chemically synthesized
tggcccacatggtctctgtcat

SEQ ID NO: 1406802 - DNA, 22 bp, Artificial Sequence
  chemically synthesized
aaacacagttgagtacttatga

SEQ ID NO: 1406803 - DNA, 22 bp, Artificial Sequence
  chemically synthesized
atgctaaaacacagttgagtac

SEQ ID NO: 1406804 - DNA, 22 bp, Artificial Sequence
  chemically synthesized
catgctaaaacacagttgagta

SEQ ID NO: 1406805 - DNA, 22 bp, Artificial Sequence
  chemically synthesized
tcatgctaaaacacagttgagt

SEQ ID NO: 1406806 - DNA, 22 bp, Artificial Sequence
  chemically synthesized
tgtcataagtactcaactgtgt

SEQ ID NO: 1406807 - DNA, 22 bp, Artificial Sequence
  chemically synthesized
ctttcatgctaaaacacagttg

SEQ ID NO: 1406808 - DNA, 22 bp, Artificial Sequence
  chemically synthesized
tcataagtactcaactgtgttt

SEQ ID NO: 1406809 - DNA, 22 bp, Artificial Sequence
  chemically synthesized
tataggactcctttcatgctaa

SEQ ID NO: 1406810 - DNA, 22 bp, Artificial Sequence
  chemically synthesized
aactgtgttttagcatgaaagg

SEQ ID NO: 1406811 - DNA, 22 bp, Artificial Sequence
  chemically synthesized
tatgctatataggactcctttc

SEQ ID NO: 1406812 - DNA, 22 bp, Artificial Sequence
  chemically synthesized
tgttttagcatgaaaggagtcc

SEQ ID NO: 1406813 - DNA, 22 bp, Artificial Sequence
  chemically synthesized
atatgctatataggactccttt

SEQ ID NO: 1406814 - DNA, 22 bp, Artificial Sequence
  chemically synthesized
tttatatgctatataggactcc

SEQ ID NO: 1406815 - DNA, 22 bp, Artificial Sequence
  chemically synthesized
gtttatatgctatataggactc

SEQ ID NO: 1406816 - DNA, 22 bp, Artificial Sequence
  chemically synthesized
tagcatgaaaggagtcctatat

SEQ ID NO: 1406817 - DNA, 22 bp, Artificial Sequence
  chemically synthesized
agcatgaaaggagtcctatata

SEQ ID NO: 1406818 - DNA, 22 bp, Artificial Sequence
  chemically synthesized
gcatgaaaggagtcctatatag

SEQ ID NO: 1406819 - DNA, 22 bp, Artificial Sequence
  chemically synthesized
tttgtttatatgctatatagga

SEQ ID NO: 1406820 - DNA, 22 bp, Artificial Sequence
  chemically synthesized
atttgtttatatgctatatagg

SEQ ID NO: 1406821 - DNA, 22 bp, Artificial Sequence
  chemically synthesized
tatagcatataaacaaataaat

SEQ ID NO: 1406822 - DNA, 22 bp, Artificial Sequence
  chemically synthesized
gaagacagccacacccatttat

SEQ ID NO: 1406823 - DNA, 22 bp, Artificial Sequence
  chemically synthesized
ggaagacagccacacccattta

SEQ ID NO: 1406824 - DNA, 22 bp, Artificial Sequence
  chemically synthesized
tttggaagacagccacacccat

SEQ ID NO: 1406825 - DNA, 22 bp, Artificial Sequence
  chemically synthesized
atttggaagacagccacaccca

SEQ ID NO: 1406826 - DNA, 22 bp, Artificial Sequence
  chemically synthesized
tagtttatttggaagacagcca

SEQ ID NO: 1406827 - DNA, 22 bp, Artificial Sequence
  chemically synthesized
agagtctatagtttatttggaa

SEQ ID NO: 1406828 - DNA, 22 bp, Artificial Sequence
  chemically synthesized
aagagtctatagtttatttgga

SEQ ID NO: 1406829 - DNA, 22 bp, Artificial Sequence
  chemically synthesized
aatttaagagtctatagtttat

SEQ ID NO: 1406830 - DNA, 22 bp, Artificial Sequence
  chemically synthesized
caatttaagagtctatagttta

SEQ ID NO: 1406831 - DNA, 22 bp, Artificial Sequence
  chemically synthesized
tcttccaaataaactatagact

SEQ ID NO: 1406832 - DNA, 22 bp, Artificial Sequence
  chemically synthesized
ccaaataaactatagactctta

SEQ ID NO: 1406833 - DNA, 22 bp, Artificial Sequence
  chemically synthesized
caaataaactatagactcttaa

SEQ ID NO: 1406834 - DNA, 22 bp, Artificial Sequence
  chemically synthesized
tataaaatttcaatttaagagt

SEQ ID NO: 1406835 - DNA, 22 bp, Artificial Sequence
  chemically synthesized
tagactcttaaattgaaatttt

SEQ ID NO: 1406836 - DNA, 22 bp, Artificial Sequence
  chemically synthesized
acacatgagattatataaaatt

SEQ ID NO: 1406837 - DNA, 22 bp, Artificial Sequence
  chemically synthesized
tgacacatgagattatataaaa

SEQ ID NO: 1406838 - DNA, 22 bp, Artificial Sequence
  chemically synthesized
ttaaattgaaattttatataat

SEQ ID NO: 1406839 - DNA, 22 bp, Artificial Sequence
  chemically synthesized
ctgacacatgagattatataaa

SEQ ID NO: 1406840 - DNA, 22 bp, Artificial Sequence
  chemically synthesized
aaattgaaattttatataatct

SEQ ID NO: 1406841 - DNA, 22 bp, Artificial Sequence
  chemically synthesized
aattgaaattttatataatctc

SEQ ID NO: 1406842 - DNA, 22 bp, Artificial Sequence
  chemically synthesized
aaattttatataatctcatgtg

SEQ ID NO: 1406843 - DNA, 22 bp, Artificial Sequence
  chemically synthesized
aagaatatttctgacacatgag

SEQ ID NO: 1406844 - DNA, 22 bp, Artificial Sequence
  chemically synthesized
caagaatatttctgacacatga

SEQ ID NO: 1406845 - DNA, 22 bp, Artificial Sequence
  chemically synthesized
tatataatctcatgtgtcagaa

SEQ ID NO: 1406846 - DNA, 22 bp, Artificial Sequence
  chemically synthesized
atataatctcatgtgtcagaaa

SEQ ID NO: 1406847 - DNA, 22 bp, Artificial Sequence
  chemically synthesized
atttcaagaatatttctgacac

SEQ ID NO: 1406848 - DNA, 22 bp, Artificial Sequence
  chemically synthesized
tataatctcatgtgtcagaaat

SEQ ID NO: 1406849 - DNA, 22 bp, Artificial Sequence
  chemically synthesized
catttcaagaatatttctgaca

SEQ ID NO: 1406850 - DNA, 22 bp, Artificial Sequence
  chemically synthesized
tttcatttcaagaatatttctg

SEQ ID NO: 1406851 - DNA, 22 bp, Artificial Sequence
  chemically synthesized
aattgtttcatttcaagaatat

SEQ ID NO: 1406852 - DNA, 22 bp, Artificial Sequence
  chemically synthesized
atgtgtcagaaatattcttgaa

SEQ ID NO: 1406853 - DNA, 22 bp, Artificial Sequence
  chemically synthesized
tgaattgtttcatttcaagaat

SEQ ID NO: 1406854 - DNA, 22 bp, Artificial Sequence
  chemically synthesized
ctgaattgtttcatttcaagaa

SEQ ID NO: 1406855 - DNA, 22 bp, Artificial Sequence
  chemically synthesized
acgtttctgaattgtttcattt

SEQ ID NO: 1406856 - DNA, 22 bp, Artificial Sequence
  chemically synthesized
cacgtttctgaattgtttcatt

SEQ ID NO: 1406857 - DNA, 22 bp, Artificial Sequence
  chemically synthesized
tcacgtttctgaattgtttcat

SEQ ID NO: 1406858 - DNA, 22 bp, Artificial Sequence
  chemically synthesized
ttgaaatgaaacaattcagaaa

SEQ ID NO: 1406859 - DNA, 22 bp, Artificial Sequence
  chemically synthesized
gaaatgaaacaattcagaaacg

SEQ ID NO: 1406860 - DNA, 22 bp, Artificial Sequence
  chemically synthesized
aaatggttttcacgtttctgaa

SEQ ID NO: 1406861 - DNA, 22 bp, Artificial Sequence
  chemically synthesized
aaatgaaacaattcagaaacgt

SEQ ID NO: 1406862 - DNA, 22 bp, Artificial Sequence
  chemically synthesized
aaaatggttttcacgtttctga

SEQ ID NO: 1406863 - DNA, 22 bp, Artificial Sequence
  chemically synthesized
accagtcatttaaaatggtttt

SEQ ID NO: 1406864 - DNA, 22 bp, Artificial Sequence
  chemically synthesized
gaccagtcatttaaaatggttt

SEQ ID NO: 1406865 - DNA, 22 bp, Artificial Sequence
  chemically synthesized
agaaacgtgaaaaccattttaa

SEQ ID NO: 1406866 - DNA, 22 bp, Artificial Sequence
  chemically synthesized
tttgaccagtcatttaaaatgg

SEQ ID NO: 1406867 - DNA, 22 bp, Artificial Sequence
  chemically synthesized
ctgtttgaccagtcatttaaaa

SEQ ID NO: 1406868 - DNA, 22 bp, Artificial Sequence
  chemically synthesized
ttactgtttgaccagtcattta

SEQ ID NO: 1406869 - DNA, 22 bp, Artificial Sequence
  chemically synthesized
tcacatctattactgtttgacc

SEQ ID NO: 1406870 - DNA, 22 bp, Artificial Sequence
  chemically synthesized
taaatgactggtcaaacagtaa

SEQ ID NO: 1406871 - DNA, 22 bp, Artificial Sequence
  chemically synthesized
aaatgactggtcaaacagtaat

SEQ ID NO: 1406872 - DNA, 22 bp, Artificial Sequence
  chemically synthesized
aatgactggtcaaacagtaata

SEQ ID NO: 1406873 - DNA, 22 bp, Artificial Sequence
  chemically synthesized
gtcaaacagtaatagatgtgac

SEQ ID NO: 1406874 - DNA, 22 bp, Artificial Sequence
  chemically synthesized
ggggtcagtaaatgatagtcca

SEQ ID NO: 1406875 - DNA, 22 bp, Artificial Sequence
  chemically synthesized
gcatcatccaggctaggggtca

SEQ ID NO: 1406876 - DNA, 22 bp, Artificial Sequence
  chemically synthesized
tcatttactgacccctagcctg

SEQ ID NO: 1406877 - DNA, 22 bp, Artificial Sequence
  chemically synthesized
cactcgcatcatccaggctagg

SEQ ID NO: 1406878 - DNA, 22 bp, Artificial Sequence
  chemically synthesized
ctccactcgcatcatccaggct

SEQ ID NO: 1406879 - DNA, 22 bp, Artificial Sequence
  chemically synthesized
actgacccctagcctggatgat

SEQ ID NO: 1406880 - DNA, 22 bp, Artificial Sequence
  chemically synthesized
ctgacccctagcctggatgatg

SEQ ID NO: 1406881 - DNA, 22 bp, Artificial Sequence
  chemically synthesized
ctactccactcgcatcatccag

SEQ ID NO: 1406882 - DNA, 22 bp, Artificial Sequence
  chemically synthesized
tactactccactcgcatcatcc

SEQ ID NO: 1406883 - DNA, 22 bp, Artificial Sequence
  chemically synthesized
acccctagcctggatgatgcga

SEQ ID NO: 1406884 - DNA, 22 bp, Artificial Sequence
  chemically synthesized
gcctggatgatgcgagtggagt

SEQ ID NO: 1406885 - DNA, 22 bp, Artificial Sequence
  chemically synthesized
agggtctctactactccactcg

SEQ ID NO: 1406886 - DNA, 22 bp, Artificial Sequence
  chemically synthesized
tgagggtctctactactccact

SEQ ID NO: 1406887 - DNA, 22 bp, Artificial Sequence
  chemically synthesized
tctgagggtctctactactcca

SEQ ID NO: 1406888 - DNA, 22 bp, Artificial Sequence
  chemically synthesized
gatgatgcgagtggagtagtag

SEQ ID NO: 1406889 - DNA, 22 bp, Artificial Sequence
  chemically synthesized
ctctgagggtctctactactcc

SEQ ID NO: 1406890 - DNA, 22 bp, Artificial Sequence
  chemically synthesized
tttctctgagggtctctactac

SEQ ID NO: 1406891 - DNA, 22 bp, Artificial Sequence
  chemically synthesized
atttctctgagggtctctacta

SEQ ID NO: 1406892 - DNA, 22 bp, Artificial Sequence
  chemically synthesized
gacatttatttctctgagggtc

SEQ ID NO: 1406893 - DNA, 22 bp, Artificial Sequence
  chemically synthesized
agacatttatttctctgagggt

SEQ ID NO: 1406894 - DNA, 22 bp, Artificial Sequence
  chemically synthesized
tagacatttatttctctgaggg

SEQ ID NO: 1406895 - DNA, 22 bp, Artificial Sequence
  chemically synthesized
ttagacatttatttctctgagg

SEQ ID NO: 1406896 - DNA, 22 bp, Artificial Sequence
  chemically synthesized
tttagacatttatttctctgag

SEQ ID NO: 1406897 - DNA, 22 bp, Artificial Sequence
  chemically synthesized
ttttagacatttatttctctga

SEQ ID NO: 1406898 - DNA, 22 bp, Artificial Sequence
  chemically synthesized
tttttagacatttatttctctg

SEQ ID NO: 1406899 - DNA, 22 bp, Artificial Sequence
  chemically synthesized
ttttttagacatttatttctct

SEQ ID NO: 1406900 - DNA, 22 bp, Artificial Sequence
  chemically synthesized
ttttttttagacatttatttct

SEQ ID NO: 1406901 - DNA, 22 bp, Artificial Sequence
  chemically synthesized
agagaaataaatgtctaaaaaa

SEQ ID NO: 1406902 - DNA, 22 bp, Artificial Sequence
  chemically synthesized
aaaacatgttcttttttttaga

SEQ ID NO: 1406903 - DNA, 22 bp, Artificial Sequence
  chemically synthesized
aaaaacatgttcttttttttag

SEQ ID NO: 1406904 - DNA, 22 bp, Artificial Sequence
  chemically synthesized
taaaaacatgttctttttttta

SEQ ID NO: 1406905 - DNA, 22 bp, Artificial Sequence
  chemically synthesized
ttaaaaacatgttctttttttt

SEQ ID NO: 1406906 - DNA, 22 bp, Artificial Sequence
  chemically synthesized
ttttaaaaacatgttctttttt

SEQ ID NO: 1406907 - DNA, 22 bp, Artificial Sequence
  chemically synthesized
cttttaaaaacatgttcttttt

SEQ ID NO: 1406908 - DNA, 22 bp, Artificial Sequence
  chemically synthesized
aaaaaaagaacatgtttttaaa

SEQ ID NO: 1406909 - DNA, 22 bp, Artificial Sequence
  chemically synthesized
tgagtccaatcatttcttttaa

SEQ ID NO: 1406910 - DNA, 22 bp, Artificial Sequence
  chemically synthesized
agaatctgtgagtccaatcatt

SEQ ID NO: 1406911 - DNA, 22 bp, Artificial Sequence
  chemically synthesized
ttaaaagaaatgattggactca

SEQ ID NO: 1406912 - DNA, 22 bp, Artificial Sequence
  chemically synthesized
actaagaatctgtgagtccaat

SEQ ID NO: 1406913 - DNA, 22 bp, Artificial Sequence
  chemically synthesized
taaaagaaatgattggactcac

SEQ ID NO: 1406914 - DNA, 22 bp, Artificial Sequence
  chemically synthesized
aactaagaatctgtgagtccaa

SEQ ID NO: 1406915 - DNA, 22 bp, Artificial Sequence
  chemically synthesized
aaaagaaatgattggactcaca

SEQ ID NO: 1406916 - DNA, 22 bp, Artificial Sequence
  chemically synthesized
taactaagaatctgtgagtcca

SEQ ID NO: 1406917 - DNA, 22 bp, Artificial Sequence
  chemically synthesized
aaagaaatgattggactcacag

SEQ ID NO: 1406918 - DNA, 22 bp, Artificial Sequence
  chemically synthesized
ttaactaagaatctgtgagtcc

SEQ ID NO: 1406919 - DNA, 22 bp, Artificial Sequence
  chemically synthesized
agataatttttaactaagaatc

SEQ ID NO: 1406920 - DNA, 22 bp, Artificial Sequence
  chemically synthesized
gactcacagattcttagttaaa

SEQ ID NO: 1406921 - DNA, 22 bp, Artificial Sequence
  chemically synthesized
acagattcttagttaaaaatta

SEQ ID NO: 1406922 - DNA, 22 bp, Artificial Sequence
  chemically synthesized
aagaagatgtctgagataattt

SEQ ID NO: 1406923 - DNA, 22 bp, Artificial Sequence
  chemically synthesized
ttagttaaaaattatctcagac

SEQ ID NO: 1406924 - DNA, 22 bp, Artificial Sequence
  chemically synthesized
agttaaaaattatctcagacat

SEQ ID NO: 1406925 - DNA, 22 bp, Artificial Sequence
  chemically synthesized
gttaaaaattatctcagacatc

SEQ ID NO: 1406926 - DNA, 22 bp, Artificial Sequence
  chemically synthesized
aaaattatctcagacatcttct

SEQ ID NO: 1406927 - DNA, 22 bp, Artificial Sequence
  chemically synthesized
aatggaaattgaagaagatgtc

SEQ ID NO: 1406928 - DNA, 22 bp, Artificial Sequence
  chemically synthesized
cactaaatggaaattgaagaag

SEQ ID NO: 1406929 - DNA, 22 bp, Artificial Sequence
  chemically synthesized
tctcagacatcttcttcaattt

SEQ ID NO: 1406930 - DNA, 22 bp, Artificial Sequence
  chemically synthesized
tgcactaaatggaaattgaaga

SEQ ID NO: 1406931 - DNA, 22 bp, Artificial Sequence
  chemically synthesized
ctgcactaaatggaaattgaag

SEQ ID NO: 1406932 - DNA, 22 bp, Artificial Sequence
  chemically synthesized
agacatcttcttcaatttccat

SEQ ID NO: 1406933 - DNA, 22 bp, Artificial Sequence
  chemically synthesized
cttcaatttccatttagtgcag

SEQ ID NO: 1406934 - DNA, 22 bp, Artificial Sequence
  chemically synthesized
agaatggagtttctgcactaaa

SEQ ID NO: 1406935 - DNA, 22 bp, Artificial Sequence
  chemically synthesized
ttcaatttccatttagtgcaga

SEQ ID NO: 1406936 - DNA, 22 bp, Artificial Sequence
  chemically synthesized
caatttccatttagtgcagaaa

SEQ ID NO: 1406937 - DNA, 22 bp, Artificial Sequence
  chemically synthesized
aatttccatttagtgcagaaac

SEQ ID NO: 1406938 - DNA, 22 bp, Artificial Sequence
  chemically synthesized
agtgctaagaatggagtttctg

SEQ ID NO: 1406939 - DNA, 22 bp, Artificial Sequence
  chemically synthesized
ccatttagtgcagaaactccat

SEQ ID NO: 1406940 - DNA, 22 bp, Artificial Sequence
  chemically synthesized
catttagtgcagaaactccatt

SEQ ID NO: 1406941 - DNA, 22 bp, Artificial Sequence
  chemically synthesized
agtgcagaaactccattcttag

SEQ ID NO: 1406942 - DNA, 22 bp, Artificial Sequence
  chemically synthesized
aagtgttcagtgctaagaatgg

SEQ ID NO: 1406943 - DNA, 22 bp, Artificial Sequence
  chemically synthesized
gtgcagaaactccattcttagc

SEQ ID NO: 1406944 - DNA, 22 bp, Artificial Sequence
  chemically synthesized
ctaaagtgttcagtgctaagaa

SEQ ID NO: 1406945 - DNA, 22 bp, Artificial Sequence
  chemically synthesized
ttcctaaagtgttcagtgctaa

SEQ ID NO: 1406946 - DNA, 22 bp, Artificial Sequence
  chemically synthesized
attcctaaagtgttcagtgcta

SEQ ID NO: 1406947 - DNA, 22 bp, Artificial Sequence
  chemically synthesized
cttattcctaaagtgttcagtg

SEQ ID NO: 1406948 - DNA, 22 bp, Artificial Sequence
  chemically synthesized
cattcttagcactgaacacttt

SEQ ID NO: 1406949 - DNA, 22 bp, Artificial Sequence
  chemically synthesized
cactccttattcctaaagtgtt

SEQ ID NO: 1406950 - DNA, 22 bp, Artificial Sequence
  chemically synthesized
ttagcactgaacactttaggaa

SEQ ID NO: 1406951 - DNA, 22 bp, Artificial Sequence
  chemically synthesized
agcactgaacactttaggaata

SEQ ID NO: 1406952 - DNA, 22 bp, Artificial Sequence
  chemically synthesized
gcactgaacactttaggaataa

SEQ ID NO: 1406953 - DNA, 22 bp, Artificial Sequence
  chemically synthesized
tgagacactgcactccttattc

SEQ ID NO: 1406954 - DNA, 22 bp, Artificial Sequence
  chemically synthesized
gtgagacactgcactccttatt

SEQ ID NO: 1406955 - DNA, 22 bp, Artificial Sequence
  chemically synthesized
aacactttaggaataaggagtg

SEQ ID NO: 1406956 - DNA, 22 bp, Artificial Sequence
  chemically synthesized
tgtgagacactgcactccttat

SEQ ID NO: 1406957 - DNA, 22 bp, Artificial Sequence
  chemically synthesized
ctttgtgagacactgcactcct

SEQ ID NO: 1406958 - DNA, 22 bp, Artificial Sequence
  chemically synthesized
taggaataaggagtgcagtgtc

SEQ ID NO: 1406959 - DNA, 22 bp, Artificial Sequence
  chemically synthesized
attactttgtgagacactgcac

SEQ ID NO: 1406960 - DNA, 22 bp, Artificial Sequence
  chemically synthesized
aggaataaggagtgcagtgtct

SEQ ID NO: 1406961 - DNA, 22 bp, Artificial Sequence
  chemically synthesized
ggaataaggagtgcagtgtctc

SEQ ID NO: 1406962 - DNA, 22 bp, Artificial Sequence
  chemically synthesized
tgagcagagaattgattacttt

SEQ ID NO: 1406963 - DNA, 22 bp, Artificial Sequence
  chemically synthesized
atgttgtgagcagagaattgat

SEQ ID NO: 1406964 - DNA, 22 bp, Artificial Sequence
  chemically synthesized
acaaagtaatcaattctctgct

SEQ ID NO: 1406965 - DNA, 22 bp, Artificial Sequence
  chemically synthesized
cagttaatgttgtgagcagaga

SEQ ID NO: 1406966 - DNA, 22 bp, Artificial Sequence
  chemically synthesized
ccagttaatgttgtgagcagag

SEQ ID NO: 1406967 - DNA, 22 bp, Artificial Sequence
  chemically synthesized
ttccagttaatgttgtgagcag

SEQ ID NO: 1406968 - DNA, 22 bp, Artificial Sequence
  chemically synthesized
tctgctcacaacattaactgga

SEQ ID NO: 1406969 - DNA, 22 bp, Artificial Sequence
  chemically synthesized
tgctcacaacattaactggaag

SEQ ID NO: 1406970 - DNA, 22 bp, Artificial Sequence
  chemically synthesized
ctcacaacattaactggaagaa

SEQ ID NO: 1406971 - DNA, 22 bp, Artificial Sequence
  chemically synthesized
acaacattaactggaagaatac

SEQ ID NO: 1406972 - DNA, 22 bp, Artificial Sequence
  chemically synthesized
gtagcaatggaaaagtattctt

SEQ ID NO: 1406973 - DNA, 22 bp, Artificial Sequence
  chemically synthesized
ggtagcaatggaaaagtattct

SEQ ID NO: 1406974 - DNA, 22 bp, Artificial Sequence
  chemically synthesized
tggtagcaatggaaaagtattc

SEQ ID NO: 1406975 - DNA, 22 bp, Artificial Sequence
  chemically synthesized
tttggtagcaatggaaaagtat

SEQ ID NO: 1406976 - DNA, 22 bp, Artificial Sequence
  chemically synthesized
actggaagaatacttttccatt

SEQ ID NO: 1406977 - DNA, 22 bp, Artificial Sequence
  chemically synthesized
cacctctttggtagcaatggaa

SEQ ID NO: 1406978 - DNA, 22 bp, Artificial Sequence
  chemically synthesized
gaagaatacttttccattgcta

SEQ ID NO: 1406979 - DNA, 22 bp, Artificial Sequence
  chemically synthesized
gcacctctttggtagcaatgga

SEQ ID NO: 1406980 - DNA, 22 bp, Artificial Sequence
  chemically synthesized
acttgcacctctttggtagcaa

SEQ ID NO: 1406981 - DNA, 22 bp, Artificial Sequence
  chemically synthesized
gactcacttgcacctctttggt

SEQ ID NO: 1406982 - DNA, 22 bp, Artificial Sequence
  chemically synthesized
agactcacttgcacctctttgg

SEQ ID NO: 1406983 - DNA, 22 bp, Artificial Sequence
  chemically synthesized
ttccattgctaccaaagaggtg

SEQ ID NO: 1406984 - DNA, 22 bp, Artificial Sequence
  chemically synthesized
tccattgctaccaaagaggtgc

SEQ ID NO: 1406985 - DNA, 22 bp, Artificial Sequence
  chemically synthesized
ccattgctaccaaagaggtgca

SEQ ID NO: 1406986 - DNA, 22 bp, Artificial Sequence
  chemically synthesized
cattgctaccaaagaggtgcaa

SEQ ID NO: 1406987 - DNA, 22 bp, Artificial Sequence
  chemically synthesized
ctaccaaagaggtgcaagtgag

SEQ ID NO: 1406988 - DNA, 22 bp, Artificial Sequence
  chemically synthesized
ccaaagaggtgcaagtgagtct

SEQ ID NO: 1406989 - DNA, 22 bp, Artificial Sequence
  chemically synthesized
taatgcagaagagggtttagac

SEQ ID NO: 1406990 - DNA, 22 bp, Artificial Sequence
  chemically synthesized
gatgtgctataatgcagaagag

SEQ ID NO: 1406991 - DNA, 22 bp, Artificial Sequence
  chemically synthesized
aaccctcttctgcattatagca

SEQ ID NO: 1406992 - DNA, 22 bp, Artificial Sequence
  chemically synthesized
aaatattcgatgtgctataatg

SEQ ID NO: 1406993 - DNA, 22 bp, Artificial Sequence
  chemically synthesized
caaatattcgatgtgctataat

SEQ ID NO: 1406994 - DNA, 22 bp, Artificial Sequence
  chemically synthesized
atttcaaatattcgatgtgcta

SEQ ID NO: 1406995 - DNA, 22 bp, Artificial Sequence
  chemically synthesized
ttctgcattatagcacatcgaa

SEQ ID NO: 1406996 - DNA, 22 bp, Artificial Sequence
  chemically synthesized
ctgcattatagcacatcgaata

SEQ ID NO: 1406997 - DNA, 22 bp, Artificial Sequence
  chemically synthesized
tgcattatagcacatcgaatat

SEQ ID NO: 1406998 - DNA, 22 bp, Artificial Sequence
  chemically synthesized
agctgatttcaaatattcgatg

SEQ ID NO: 1406999 - DNA, 22 bp, Artificial Sequence
  chemically synthesized
cattatagcacatcgaatattt

SEQ ID NO: 1407000 - DNA, 22 bp, Artificial Sequence
  chemically synthesized
tagcacatcgaatatttgaaat

SEQ ID NO: 1407001 - DNA, 22 bp, Artificial Sequence
  chemically synthesized
aaggaaaaaagtagagaaaatt

SEQ ID NO: 1407002 - DNA, 22 bp, Artificial Sequence
  chemically synthesized
gaaatcagcttaattttctcta

SEQ ID NO: 1407003 - DNA, 22 bp, Artificial Sequence
  chemically synthesized
gaaggaaaaaagtagagaaaat

SEQ ID NO: 1407004 - DNA, 22 bp, Artificial Sequence
  chemically synthesized
aaatcagcttaattttctctac

SEQ ID NO: 1407005 - DNA, 22 bp, Artificial Sequence
  chemically synthesized
aagaatacttgaaggaaaaaag

SEQ ID NO: 1407006 - DNA, 22 bp, Artificial Sequence
  chemically synthesized
aattttctctacttttttcctt

SEQ ID NO: 1407007 - DNA, 22 bp, Artificial Sequence
  chemically synthesized
attttctctacttttttccttc

SEQ ID NO: 1407008 - DNA, 22 bp, Artificial Sequence
  chemically synthesized
tctctacttttttccttcaagt

SEQ ID NO: 1407009 - DNA, 22 bp, Artificial Sequence
  chemically synthesized
ctctacttttttccttcaagta

SEQ ID NO: 1407010 - DNA, 22 bp, Artificial Sequence
  chemically synthesized
tctacttttttccttcaagtat

SEQ ID NO: 1407011 - DNA, 22 bp, Artificial Sequence
  chemically synthesized
tacttttttccttcaagtattc

SEQ ID NO: 1407012 - DNA, 22 bp, Artificial Sequence
  chemically synthesized
cttttttccttcaagtattctt

SEQ ID NO: 1407013 - DNA, 22 bp, Artificial Sequence
  chemically synthesized
ttttccttcaagtattcttcaa

SEQ ID NO: 1407014 - DNA, 22 bp, Artificial Sequence
  chemically synthesized
tttccttcaagtattcttcaac

SEQ ID NO: 1407015 - DNA, 22 bp, Artificial Sequence
  chemically synthesized
gaaaagtgaaaagttgaagaat

SEQ ID NO: 1407016 - DNA, 22 bp, Artificial Sequence
  chemically synthesized
ttccttcaagtattcttcaact

SEQ ID NO: 1407017 - DNA, 22 bp, Artificial Sequence
  chemically synthesized
tccttcaagtattcttcaactt

SEQ ID NO: 1407018 - DNA, 22 bp, Artificial Sequence
  chemically synthesized
ccttcaagtattcttcaacttt

SEQ ID NO: 1407019 - DNA, 22 bp, Artificial Sequence
  chemically synthesized
cttcaagtattcttcaactttt

SEQ ID NO: 1407020 - DNA, 22 bp, Artificial Sequence
  chemically synthesized
caagtattcttcaacttttcac

SEQ ID NO: 1407021 - DNA, 22 bp, Artificial Sequence
  chemically synthesized
aagtattcttcaacttttcact

SEQ ID NO: 1407022 - DNA, 22 bp, Artificial Sequence
  chemically synthesized
ttcaacttttcacttttctagt

SEQ ID NO: 1407023 - DNA, 22 bp, Artificial Sequence
  chemically synthesized
caacttttcacttttctagtac

SEQ ID NO: 1407024 - DNA, 22 bp, Artificial Sequence
  chemically synthesized
aacttttcacttttctagtact

SEQ ID NO: 1407025 - DNA, 22 bp, Artificial Sequence
  chemically synthesized
aggggcatggaaagtactagaa

SEQ ID NO: 1407026 - DNA, 22 bp, Artificial Sequence
  chemically synthesized
gaggggcatggaaagtactaga

SEQ ID NO: 1407027 - DNA, 22 bp, Artificial Sequence
  chemically synthesized
ttcacttttctagtactttcca

SEQ ID NO: 1407028 - DNA, 22 bp, Artificial Sequence
  chemically synthesized
tcacttttctagtactttccat

SEQ ID NO: 1407029 - DNA, 22 bp, Artificial Sequence
  chemically synthesized
cacttttctagtactttccatg

SEQ ID NO: 1407030 - DNA, 22 bp, Artificial Sequence
  chemically synthesized
acttttctagtactttccatgc

SEQ ID NO: 1407031 - DNA, 22 bp, Artificial Sequence
  chemically synthesized
taacatttgaggggcatggaaa

SEQ ID NO: 1407032 - DNA, 22 bp, Artificial Sequence
  chemically synthesized
ttctagtactttccatgcccct

SEQ ID NO: 1407033 - DNA, 22 bp, Artificial Sequence
  chemically synthesized
tctagtactttccatgcccctc

SEQ ID NO: 1407034 - DNA, 22 bp, Artificial Sequence
  chemically synthesized
ctagtactttccatgcccctca

SEQ ID NO: 1407035 - DNA, 22 bp, Artificial Sequence
  chemically synthesized
tagtactttccatgcccctcaa

SEQ ID NO: 1407036 - DNA, 22 bp, Artificial Sequence
  chemically synthesized
caaactataacatttgaggggc

SEQ ID NO: 1407037 - DNA, 22 bp, Artificial Sequence
  chemically synthesized
gtactttccatgcccctcaaat

SEQ ID NO: 1407038 - DNA, 22 bp, Artificial Sequence
  chemically synthesized
tccatgcccctcaaatgttata

SEQ ID NO: 1407039 - DNA, 22 bp, Artificial Sequence
  chemically synthesized
ccatgcccctcaaatgttatag

SEQ ID NO: 1407040 - DNA, 22 bp, Artificial Sequence
  chemically synthesized
catgcccctcaaatgttatagt

SEQ ID NO: 1407041 - DNA, 22 bp, Artificial Sequence
  chemically synthesized
aaaggtcctacaaactataaca

SEQ ID NO: 1407042 - DNA, 22 bp, Artificial Sequence
  chemically synthesized
aatgctaaaaggtcctacaaac

SEQ ID NO: 1407043 - DNA, 22 bp, Artificial Sequence
  chemically synthesized
aaatgttatagtttgtaggacc

SEQ ID NO: 1407044 - DNA, 22 bp, Artificial Sequence
  chemically synthesized
tagtttgtaggaccttttagca

SEQ ID NO: 1407045 - DNA, 22 bp, Artificial Sequence
  chemically synthesized
agtgaaaagtgtctgaatgcta

SEQ ID NO: 1407046 - DNA, 22 bp, Artificial Sequence
  chemically synthesized
gtaggaccttttagcattcaga

SEQ ID NO: 1407047 - DNA, 22 bp, Artificial Sequence
  chemically synthesized
taggaccttttagcattcagac

SEQ ID NO: 1407048 - DNA, 22 bp, Artificial Sequence
  chemically synthesized
ttagcattcagacacttttcac

SEQ ID NO: 1407049 - DNA, 22 bp, Artificial Sequence
  chemically synthesized
ggggtatgttcagtgaaaagtg

SEQ ID NO: 1407050 - DNA, 22 bp, Artificial Sequence
  chemically synthesized
tagcattcagacacttttcact

SEQ ID NO: 1407051 - DNA, 22 bp, Artificial Sequence
  chemically synthesized
gggggtatgttcagtgaaaagt

SEQ ID NO: 1407052 - DNA, 22 bp, Artificial Sequence
  chemically synthesized
agcattcagacacttttcactg

SEQ ID NO: 1407053 - DNA, 22 bp, Artificial Sequence
  chemically synthesized
gcattcagacacttttcactga

SEQ ID NO: 1407054 - DNA, 22 bp, Artificial Sequence
  chemically synthesized
acatttgggggtatgttcagtg

SEQ ID NO: 1407055 - DNA, 22 bp, Artificial Sequence
  chemically synthesized
aacatttgggggtatgttcagt

SEQ ID NO: 1407056 - DNA, 22 bp, Artificial Sequence
  chemically synthesized
agacacttttcactgaacatac

SEQ ID NO: 1407057 - DNA, 22 bp, Artificial Sequence
  chemically synthesized
ttcactgaacatacccccaaat

SEQ ID NO: 1407058 - DNA, 22 bp, Artificial Sequence
  chemically synthesized
tcactgaacatacccccaaatg

SEQ ID NO: 1407059 - DNA, 22 bp, Artificial Sequence
  chemically synthesized
cactgaacatacccccaaatgt

SEQ ID NO: 1407060 - DNA, 22 bp, Artificial Sequence
  chemically synthesized
agaggaaccttaacatttgggg

SEQ ID NO: 1407061 - DNA, 22 bp, Artificial Sequence
  chemically synthesized
actgaacatacccccaaatgtt

SEQ ID NO: 1407062 - DNA, 22 bp, Artificial Sequence
  chemically synthesized
aacatacccccaaatgttaagg

SEQ ID NO: 1407063 - DNA, 22 bp, Artificial Sequence
  chemically synthesized
gaaggacaccatgatctaagag

SEQ ID NO: 1407064 - DNA, 22 bp, Artificial Sequence
  chemically synthesized
agaaggacaccatgatctaaga

SEQ ID NO: 1407065 - DNA, 22 bp, Artificial Sequence
  chemically synthesized
tagaaggacaccatgatctaag

SEQ ID NO: 1407066 - DNA, 22 bp, Artificial Sequence
  chemically synthesized
aggttcctcttagatcatggtg

SEQ ID NO: 1407067 - DNA, 22 bp, Artificial Sequence
  chemically synthesized
ctcttagatcatggtgtccttc

SEQ ID NO: 1407068 - DNA, 22 bp, Artificial Sequence
  chemically synthesized
ttagatcatggtgtccttctaa

SEQ ID NO: 1407069 - DNA, 22 bp, Artificial Sequence
  chemically synthesized
agatcatggtgtccttctaaaa

SEQ ID NO: 1407070 - DNA, 22 bp, Artificial Sequence
  chemically synthesized
gatcatggtgtccttctaaaat

SEQ ID NO: 1407071 - DNA, 22 bp, Artificial Sequence
  chemically synthesized
tatgtggtaatatatacatatt

SEQ ID NO: 1407072 - DNA, 22 bp, Artificial Sequence
  chemically synthesized
ctaaaatatgtatatattacca

SEQ ID NO: 1407073 - DNA, 22 bp, Artificial Sequence
  chemically synthesized
taaaatatgtatatattaccac

SEQ ID NO: 1407074 - DNA, 22 bp, Artificial Sequence
  chemically synthesized
aaatatgtatatattaccacat

SEQ ID NO: 1407075 - DNA, 22 bp, Artificial Sequence
  chemically synthesized
ccacatataatatatacatata

SEQ ID NO: 1407076 - DNA, 22 bp, Artificial Sequence
  chemically synthesized
tcatatatatacacacacacac

SEQ ID NO: 1407077 - DNA, 22 bp, Artificial Sequence
  chemically synthesized
gaaggatatatatgatataatg

SEQ ID NO: 1407078 - DNA, 22 bp, Artificial Sequence
  chemically synthesized
agaaggatatatatgatataat

SEQ ID NO: 1407079 - DNA, 22 bp, Artificial Sequence
  chemically synthesized
tagaaggatatatatgatataa

SEQ ID NO: 1407080 - DNA, 22 bp, Artificial Sequence
  chemically synthesized
tatcatatatatccttctaaaa

SEQ ID NO: 1407081 - DNA, 22 bp, Artificial Sequence
  chemically synthesized
ctaaaattcgttctcatttttt

SEQ ID NO: 1407082 - DNA, 22 bp, Artificial Sequence
  chemically synthesized
taaaattcgttctcattttttt

SEQ ID NO: 1407083 - DNA, 22 bp, Artificial Sequence
  chemically synthesized
aaaaaggaaatgaaaaaaatga

SEQ ID NO: 1407084 - DNA, 22 bp, Artificial Sequence
  chemically synthesized
aaattcgttctcatttttttca

SEQ ID NO: 1407085 - DNA, 22 bp, Artificial Sequence
  chemically synthesized
gttctcatttttttcatttcct

SEQ ID NO: 1407086 - DNA, 22 bp, Artificial Sequence
  chemically synthesized
tcatttttttcatttccttttt

SEQ ID NO: 1407087 - DNA, 22 bp, Artificial Sequence
  chemically synthesized
gacatgtatcctgaaaaaggaa

SEQ ID NO: 1407088 - DNA, 22 bp, Artificial Sequence
  chemically synthesized
atttttttcatttcctttttca

SEQ ID NO: 1407089 - DNA, 22 bp, Artificial Sequence
  chemically synthesized
ttagacatgtatcctgaaaaag

SEQ ID NO: 1407090 - DNA, 22 bp, Artificial Sequence
  chemically synthesized
ttttcatttcctttttcaggat

SEQ ID NO: 1407091 - DNA, 22 bp, Artificial Sequence
  chemically synthesized
tttcatttcctttttcaggata

SEQ ID NO: 1407092 - DNA, 22 bp, Artificial Sequence
  chemically synthesized
ttcatttcctttttcaggatac

SEQ ID NO: 1407093 - DNA, 22 bp, Artificial Sequence
  chemically synthesized
tcatttcctttttcaggataca

SEQ ID NO: 1407094 - DNA, 22 bp, Artificial Sequence
  chemically synthesized
catttcctttttcaggatacat

SEQ ID NO: 1407095 - DNA, 22 bp, Artificial Sequence
  chemically synthesized
atttcctttttcaggatacatg

SEQ ID NO: 1407096 - DNA, 22 bp, Artificial Sequence
  chemically synthesized
cctttttcaggatacatgtcta

SEQ ID NO: 1407097 - DNA, 22 bp, Artificial Sequence
  chemically synthesized
ctttttcaggatacatgtctaa

SEQ ID NO: 1407098 - DNA, 22 bp, Artificial Sequence
  chemically synthesized
tttcaggatacatgtctaacaa

SEQ ID NO: 1407099 - DNA, 22 bp, Artificial Sequence
  chemically synthesized
ttcaggatacatgtctaacaat

SEQ ID NO: 1407100 - DNA, 22 bp, Artificial Sequence
  chemically synthesized
tcaggatacatgtctaacaata

SEQ ID NO: 1407101 - DNA, 22 bp, Artificial Sequence
  chemically synthesized
caggatacatgtctaacaatat

SEQ ID NO: 1407102 - DNA, 22 bp, Artificial Sequence
  chemically synthesized
aggatacatgtctaacaatatt

SEQ ID NO: 1407103 - DNA, 22 bp, Artificial Sequence
  chemically synthesized
acaatattactttgtttcattg

SEQ ID NO: 1407104 - DNA, 22 bp, Artificial Sequence
  chemically synthesized
atatgacatcaaaatacaatga

SEQ ID NO: 1407105 - DNA, 22 bp, Artificial Sequence
  chemically synthesized
ctttgtttcattgtattttgat

SEQ ID NO: 1407106 - DNA, 22 bp, Artificial Sequence
  chemically synthesized
tgtttcattgtattttgatgtc

SEQ ID NO: 1407107 - DNA, 22 bp, Artificial Sequence
  chemically synthesized
gtttcattgtattttgatgtca

SEQ ID NO: 1407108 - DNA, 22 bp, Artificial Sequence
  chemically synthesized
tttcattgtattttgatgtcat

SEQ ID NO: 1407109 - DNA, 22 bp, Artificial Sequence
  chemically synthesized
cattgtattttgatgtcatatg

SEQ ID NO: 1407110 - DNA, 22 bp, Artificial Sequence
  chemically synthesized
tcagtcataattcatatgacat

SEQ ID NO: 1407111 - DNA, 22 bp, Artificial Sequence
  chemically synthesized
attgtattttgatgtcatatga

SEQ ID NO: 1407112 - DNA, 22 bp, Artificial Sequence
  chemically synthesized
ttatcagtcataattcatatga

SEQ ID NO: 1407113 - DNA, 22 bp, Artificial Sequence
  chemically synthesized
tattttgatgtcatatgaatta

SEQ ID NO: 1407114 - DNA, 22 bp, Artificial Sequence
  chemically synthesized
tgatgtcatatgaattatgact

SEQ ID NO: 1407115 - DNA, 22 bp, Artificial Sequence
  chemically synthesized
gatgtcatatgaattatgactg

SEQ ID NO: 1407116 - DNA, 22 bp, Artificial Sequence
  chemically synthesized
atgtcatatgaattatgactga

SEQ ID NO: 1407117 - DNA, 22 bp, Artificial Sequence
  chemically synthesized
gtcatcattattatcagtcata

SEQ ID NO: 1407118 - DNA, 22 bp, Artificial Sequence
  chemically synthesized
ttggtcatcattattatcagtc

SEQ ID NO: 1407119 - DNA, 22 bp, Artificial Sequence
  chemically synthesized
gttggtcatcattattatcagt

SEQ ID NO: 1407120 - DNA, 22 bp, Artificial Sequence
  chemically synthesized
tgttggtcatcattattatcag

SEQ ID NO: 1407121 - DNA, 22 bp, Artificial Sequence
  chemically synthesized
attttgttggtcatcattatta

SEQ ID NO: 1407122 - DNA, 22 bp, Artificial Sequence
  chemically synthesized
ctgattttgttggtcatcatta

SEQ ID NO: 1407123 - DNA, 22 bp, Artificial Sequence
  chemically synthesized
actgattttgttggtcatcatt

SEQ ID NO: 1407124 - DNA, 22 bp, Artificial Sequence
  chemically synthesized
tgactgataataatgatgacca

SEQ ID NO: 1407125 - DNA, 22 bp, Artificial Sequence
  chemically synthesized
ataataatgatgaccaacaaaa

SEQ ID NO: 1407126 - DNA, 22 bp, Artificial Sequence
  chemically synthesized
aataaatcttactgattttgtt

SEQ ID NO: 1407127 - DNA, 22 bp, Artificial Sequence
  chemically synthesized
attgaataaatcttactgattt

SEQ ID NO: 1407128 - DNA, 22 bp, Artificial Sequence
  chemically synthesized
gtaataattaattgaataaatc

SEQ ID NO: 1407129 - DNA, 22 bp, Artificial Sequence
  chemically synthesized
agtaataattaattgaataaat

SEQ ID NO: 1407130 - DNA, 22 bp, Artificial Sequence
  chemically synthesized
aagcttagtaataattaattga

SEQ ID NO: 1407131 - DNA, 22 bp, Artificial Sequence
  chemically synthesized
attcaattaattattactaagc

SEQ ID NO: 1407132 - DNA, 22 bp, Artificial Sequence
  chemically synthesized
ttcaattaattattactaagct

SEQ ID NO: 1407133 - DNA, 22 bp, Artificial Sequence
  chemically synthesized
aattaattattactaagcttta

SEQ ID NO: 1407134 - DNA, 22 bp, Artificial Sequence
  chemically synthesized
attattactaagctttaactct

SEQ ID NO: 1407135 - DNA, 22 bp, Artificial Sequence
  chemically synthesized
ttactaagctttaactctctca

SEQ ID NO: 1407136 - DNA, 22 bp, Artificial Sequence
  chemically synthesized
gcaagtacaggacatgagagag

SEQ ID NO: 1407137 - DNA, 22 bp, Artificial Sequence
  chemically synthesized
ctaagctttaactctctcatgt

SEQ ID NO: 1407138 - DNA, 22 bp, Artificial Sequence
  chemically synthesized
agctttaactctctcatgtcct

SEQ ID NO: 1407139 - DNA, 22 bp, Artificial Sequence
  chemically synthesized
taactctctcatgtcctgtact

SEQ ID NO: 1407140 - DNA, 22 bp, Artificial Sequence
  chemically synthesized
aactctctcatgtcctgtactt

SEQ ID NO: 1407141 - DNA, 22 bp, Artificial Sequence
  chemically synthesized
actctctcatgtcctgtacttg

SEQ ID NO: 1407142 - DNA, 22 bp, Artificial Sequence
  chemically synthesized
ataaaatcaatctggcaagtac

SEQ ID NO: 1407143 - DNA, 22 bp, Artificial Sequence
  chemically synthesized
tctcatgtcctgtacttgccag

SEQ ID NO: 1407144 - DNA, 22 bp, Artificial Sequence
  chemically synthesized
tcatgtcctgtacttgccagat

SEQ ID NO: 1407145 - DNA, 22 bp, Artificial Sequence
  chemically synthesized
atgtcctgtacttgccagattg

SEQ ID NO: 1407146 - DNA, 22 bp, Artificial Sequence
  chemically synthesized
aggttcataaaatcaatctggc

SEQ ID NO: 1407147 - DNA, 22 bp, Artificial Sequence
  chemically synthesized
agctaaggttcataaaatcaat

SEQ ID NO: 1407148 - DNA, 22 bp, Artificial Sequence
  chemically synthesized
tacttgccagattgattttatg

SEQ ID NO: 1407149 - DNA, 22 bp, Artificial Sequence
  chemically synthesized
gccagattgattttatgaacct

SEQ ID NO: 1407150 - DNA, 22 bp, Artificial Sequence
  chemically synthesized
ccagattgattttatgaacctt

SEQ ID NO: 1407151 - DNA, 22 bp, Artificial Sequence
  chemically synthesized
attttatgaaccttagcttagg

SEQ ID NO: 1407152 - DNA, 22 bp, Artificial Sequence
  chemically synthesized
tatgaaccttagcttaggatgt

SEQ ID NO: 1407153 - DNA, 22 bp, Artificial Sequence
  chemically synthesized
atgaaccttagcttaggatgtt

SEQ ID NO: 1407154 - DNA, 22 bp, Artificial Sequence
  chemically synthesized
tgaaccttagcttaggatgtta

SEQ ID NO: 1407155 - DNA, 22 bp, Artificial Sequence
  chemically synthesized
taataggaataagtataacatc

SEQ ID NO: 1407156 - DNA, 22 bp, Artificial Sequence
  chemically synthesized
agcttaggatgttatacttatt

SEQ ID NO: 1407157 - DNA, 22 bp, Artificial Sequence
  chemically synthesized
gcttaggatgttatacttattc

SEQ ID NO: 1407158 - DNA, 22 bp, Artificial Sequence
  chemically synthesized
aggatgttatacttattcctat

SEQ ID NO: 1407159 - DNA, 22 bp, Artificial Sequence
  chemically synthesized
ggatgttatacttattcctatt

SEQ ID NO: 1407160 - DNA, 22 bp, Artificial Sequence
  chemically synthesized
tacttattcctattacaattat

SEQ ID NO: 1407161 - DNA, 22 bp, Artificial Sequence
  chemically synthesized
attcctattacaattattctct

SEQ ID NO: 1407162 - DNA, 22 bp, Artificial Sequence
  chemically synthesized
tggtgaggtcaaagagaataat

SEQ ID NO: 1407163 - DNA, 22 bp, Artificial Sequence
  chemically synthesized
ttcctattacaattattctctt

SEQ ID NO: 1407164 - DNA, 22 bp, Artificial Sequence
  chemically synthesized
ctattacaattattctctttga

SEQ ID NO: 1407165 - DNA, 22 bp, Artificial Sequence
  chemically synthesized
ttacaattattctctttgacct

SEQ ID NO: 1407166 - DNA, 22 bp, Artificial Sequence
  chemically synthesized
aaaactgtggtgaggtcaaaga

SEQ ID NO: 1407167 - DNA, 22 bp, Artificial Sequence
  chemically synthesized
caattattctctttgacctcac

SEQ ID NO: 1407168 - DNA, 22 bp, Artificial Sequence
  chemically synthesized
ttctctttgacctcaccacagt

SEQ ID NO: 1407169 - DNA, 22 bp, Artificial Sequence
  chemically synthesized
tgaccacctaaaaactgtggtg

SEQ ID NO: 1407170 - DNA, 22 bp, Artificial Sequence
  chemically synthesized
tctttgacctcaccacagtttt

SEQ ID NO: 1407171 - DNA, 22 bp, Artificial Sequence
  chemically synthesized
tttgacctcaccacagttttta

SEQ ID NO: 1407172 - DNA, 22 bp, Artificial Sequence
  chemically synthesized
tgacctcaccacagtttttagg

SEQ ID NO: 1407173 - DNA, 22 bp, Artificial Sequence
  chemically synthesized
gacctcaccacagtttttaggt

SEQ ID NO: 1407174 - DNA, 22 bp, Artificial Sequence
  chemically synthesized
acctcaccacagtttttaggtg

SEQ ID NO: 1407175 - DNA, 22 bp, Artificial Sequence
  chemically synthesized
accacagtttttaggtggtcat

SEQ ID NO: 1407176 - DNA, 22 bp, Artificial Sequence
  chemically synthesized
gggtaccaaaggattatgacca

SEQ ID NO: 1407177 - DNA, 22 bp, Artificial Sequence
  chemically synthesized
ttagggtaccaaaggattatga

SEQ ID NO: 1407178 - DNA, 22 bp, Artificial Sequence
  chemically synthesized
ttaggtggtcataatcctttgg

SEQ ID NO: 1407179 - DNA, 22 bp, Artificial Sequence
  chemically synthesized
taggtggtcataatcctttggt

SEQ ID NO: 1407180 - DNA, 22 bp, Artificial Sequence
  chemically synthesized
aactattagggtaccaaaggat

SEQ ID NO: 1407181 - DNA, 22 bp, Artificial Sequence
  chemically synthesized
aggtggtcataatcctttggta

SEQ ID NO: 1407182 - DNA, 22 bp, Artificial Sequence
  chemically synthesized
ggtggtcataatcctttggtac

SEQ ID NO: 1407183 - DNA, 22 bp, Artificial Sequence
  chemically synthesized
tggtaccctaatagttcaatgt

SEQ ID NO: 1407184 - DNA, 22 bp, Artificial Sequence
  chemically synthesized
ggtaccctaatagttcaatgta

SEQ ID NO: 1407185 - DNA, 22 bp, Artificial Sequence
  chemically synthesized
gtaccctaatagttcaatgtat

SEQ ID NO: 1407186 - DNA, 22 bp, Artificial Sequence
  chemically synthesized
ggaagcagaacaaatacattga

SEQ ID NO: 1407187 - DNA, 22 bp, Artificial Sequence
  chemically synthesized
tctgggaagcagaacaaataca

SEQ ID NO: 1407188 - DNA, 22 bp, Artificial Sequence
  chemically synthesized
atagttcaatgtatttgttctg

SEQ ID NO: 1407189 - DNA, 22 bp, Artificial Sequence
  chemically synthesized
tctatctgggaagcagaacaaa

SEQ ID NO: 1407190 - DNA, 22 bp, Artificial Sequence
  chemically synthesized
aatgtatttgttctgcttccca

SEQ ID NO: 1407191 - DNA, 22 bp, Artificial Sequence
  chemically synthesized
gttctgcttcccagatagacag

SEQ ID NO: 1407192 - DNA, 22 bp, Artificial Sequence
  chemically synthesized
ttctgcttcccagatagacagg

SEQ ID NO: 1407193 - DNA, 22 bp, Artificial Sequence
  chemically synthesized
tgcttcccagatagacaggcta

SEQ ID NO: 1407194 - DNA, 22 bp, Artificial Sequence
  chemically synthesized
cttcccagatagacaggctatc

SEQ ID NO: 1407195 - DNA, 22 bp, Artificial Sequence
  chemically synthesized
aaggacgatccagatagcctgt

SEQ ID NO: 1407196 - DNA, 22 bp, Artificial Sequence
  chemically synthesized
cccagatagacaggctatctgg

SEQ ID NO: 1407197 - DNA, 22 bp, Artificial Sequence
  chemically synthesized
ccagatagacaggctatctgga

SEQ ID NO: 1407198 - DNA, 22 bp, Artificial Sequence
  chemically synthesized
atgtccaaaaactgaaggacga

SEQ ID NO: 1407199 - DNA, 22 bp, Artificial Sequence
  chemically synthesized
tctggatcgtccttcagttttt

SEQ ID NO: 1407200 - DNA, 22 bp, Artificial Sequence
  chemically synthesized
gatcgtccttcagtttttggac

SEQ ID NO: 1407201 - DNA, 22 bp, Artificial Sequence
  chemically synthesized
tgaaatattaatgtccaaaaac

SEQ ID NO: 1407202 - DNA, 22 bp, Artificial Sequence
  chemically synthesized
gcctgtgaaatattaatgtcca

SEQ ID NO: 1407203 - DNA, 22 bp, Artificial Sequence
  chemically synthesized
ggcctgtgaaatattaatgtcc

SEQ ID NO: 1407204 - DNA, 22 bp, Artificial Sequence
  chemically synthesized
cttggcctgtgaaatattaatg

SEQ ID NO: 1407205 - DNA, 22 bp, Artificial Sequence
  chemically synthesized
cagtttttggacattaatattt

SEQ ID NO: 1407206 - DNA, 22 bp, Artificial Sequence
  chemically synthesized
agtttttggacattaatatttc

SEQ ID NO: 1407207 - DNA, 22 bp, Artificial Sequence
  chemically synthesized
aacctacttggcctgtgaaata

SEQ ID NO: 1407208 - DNA, 22 bp, Artificial Sequence
  chemically synthesized
ttggacattaatatttcacagg

SEQ ID NO: 1407209 - DNA, 22 bp, Artificial Sequence
  chemically synthesized
gaacctacttggcctgtgaaat

SEQ ID NO: 1407210 - DNA, 22 bp, Artificial Sequence
  chemically synthesized
tggacattaatatttcacaggc

SEQ ID NO: 1407211 - DNA, 22 bp, Artificial Sequence
  chemically synthesized
ggacattaatatttcacaggcc

SEQ ID NO: 1407212 - DNA, 22 bp, Artificial Sequence
  chemically synthesized
ttgaacctacttggcctgtgaa

SEQ ID NO: 1407213 - DNA, 22 bp, Artificial Sequence
  chemically synthesized
gacattaatatttcacaggcca

SEQ ID NO: 1407214 - DNA, 22 bp, Artificial Sequence
  chemically synthesized
ttcttgaacctacttggcctgt

SEQ ID NO: 1407215 - DNA, 22 bp, Artificial Sequence
  chemically synthesized
tgttcttgaacctacttggcct

SEQ ID NO: 1407216 - DNA, 22 bp, Artificial Sequence
  chemically synthesized
atatttcacaggccaagtaggt

SEQ ID NO: 1407217 - DNA, 22 bp, Artificial Sequence
  chemically synthesized
tgtctctgttcttgaacctact

SEQ ID NO: 1407218 - DNA, 22 bp, Artificial Sequence
  chemically synthesized
atgtctctgttcttgaacctac

SEQ ID NO: 1407219 - DNA, 22 bp, Artificial Sequence
  chemically synthesized
cacaggccaagtaggttcaaga

SEQ ID NO: 1407220 - DNA, 22 bp, Artificial Sequence
  chemically synthesized
acaggccaagtaggttcaagaa

SEQ ID NO: 1407221 - DNA, 22 bp, Artificial Sequence
  chemically synthesized
taatgtgccttatgtctctgtt

SEQ ID NO: 1407222 - DNA, 22 bp, Artificial Sequence
  chemically synthesized
tgtaatgtgccttatgtctctg

SEQ ID NO: 1407223 - DNA, 22 bp, Artificial Sequence
  chemically synthesized
ctgtaatgtgccttatgtctct

SEQ ID NO: 1407224 - DNA, 22 bp, Artificial Sequence
  chemically synthesized
atcttctgtaatgtgccttatg

SEQ ID NO: 1407225 - DNA, 22 bp, Artificial Sequence
  chemically synthesized
aagaacagagacataaggcaca

SEQ ID NO: 1407226 - DNA, 22 bp, Artificial Sequence
  chemically synthesized
aacctaatcttctgtaatgtgc

SEQ ID NO: 1407227 - DNA, 22 bp, Artificial Sequence
  chemically synthesized
gaacctaatcttctgtaatgtg

SEQ ID NO: 1407228 - DNA, 22 bp, Artificial Sequence
  chemically synthesized
acttgaacctaatcttctgtaa

SEQ ID NO: 1407229 - DNA, 22 bp, Artificial Sequence
  chemically synthesized
catctgacttgaacctaatctt

SEQ ID NO: 1407230 - DNA, 22 bp, Artificial Sequence
  chemically synthesized
gttccatctgacttgaacctaa

SEQ ID NO: 1407231 - DNA, 22 bp, Artificial Sequence
  chemically synthesized
cagaagattaggttcaagtcag

SEQ ID NO: 1407232 - DNA, 22 bp, Artificial Sequence
  chemically synthesized
taaaattggttccatctgactt

SEQ ID NO: 1407233 - DNA, 22 bp, Artificial Sequence
  chemically synthesized
tataaaattggttccatctgac

SEQ ID NO: 1407234 - DNA, 22 bp, Artificial Sequence
  chemically synthesized
ggttcaagtcagatggaaccaa

SEQ ID NO: 1407235 - DNA, 22 bp, Artificial Sequence
  chemically synthesized
aagtcagatggaaccaatttta

SEQ ID NO: 1407236 - DNA, 22 bp, Artificial Sequence
  chemically synthesized
tagcatagttctataaaattgg

SEQ ID NO: 1407237 - DNA, 22 bp, Artificial Sequence
  chemically synthesized
acaggactatagcatagttcta

SEQ ID NO: 1407238 - DNA, 22 bp, Artificial Sequence
  chemically synthesized
cacaggactatagcatagttct

SEQ ID NO: 1407239 - DNA, 22 bp, Artificial Sequence
  chemically synthesized
tcacaggactatagcatagttc

SEQ ID NO: 1407240 - DNA, 22 bp, Artificial Sequence
  chemically synthesized
tatagaactatgctatagtcct

SEQ ID NO: 1407241 - DNA, 22 bp, Artificial Sequence
  chemically synthesized
atagaactatgctatagtcctg

SEQ ID NO: 1407242 - DNA, 22 bp, Artificial Sequence
  chemically synthesized
tagaactatgctatagtcctgt

SEQ ID NO: 1407243 - DNA, 22 bp, Artificial Sequence
  chemically synthesized
tgctatagtcctgtgaaaggcc

SEQ ID NO: 1407244 - DNA, 22 bp, Artificial Sequence
  chemically synthesized
tagtcctgtgaaaggccctctt

SEQ ID NO: 1407245 - DNA, 22 bp, Artificial Sequence
  chemically synthesized
tgaaaggccctcttcctggttt

SEQ ID NO: 1407246 - DNA, 22 bp, Artificial Sequence
  chemically synthesized
atgaatcacagtaaaccaggaa

SEQ ID NO: 1407247 - DNA, 22 bp, Artificial Sequence
  chemically synthesized
ttcctggtttactgtgattcat

SEQ ID NO: 1407248 - DNA, 22 bp, Artificial Sequence
  chemically synthesized
cctggtttactgtgattcatta

SEQ ID NO: 1407249 - DNA, 22 bp, Artificial Sequence
  chemically synthesized
tgatgtatcaattaatgaatca

SEQ ID NO: 1407250 - DNA, 22 bp, Artificial Sequence
  chemically synthesized
ctggtttactgtgattcattaa

SEQ ID NO: 1407251 - DNA, 22 bp, Artificial Sequence
  chemically synthesized
gtttactgtgattcattaattg

SEQ ID NO: 1407252 - DNA, 22 bp, Artificial Sequence
  chemically synthesized
cctgtgatgtatcaattaatga

SEQ ID NO: 1407253 - DNA, 22 bp, Artificial Sequence
  chemically synthesized
actgtgattcattaattgatac

SEQ ID NO: 1407254 - DNA, 22 bp, Artificial Sequence
  chemically synthesized
ctgtgattcattaattgataca

SEQ ID NO: 1407255 - DNA, 22 bp, Artificial Sequence
  chemically synthesized
tgattcattaattgatacatca

SEQ ID NO: 1407256 - DNA, 22 bp, Artificial Sequence
  chemically synthesized
aatgaccctgcctgtgatgtat

SEQ ID NO: 1407257 - DNA, 22 bp, Artificial Sequence
  chemically synthesized
attaattgatacatcacaggca

SEQ ID NO: 1407258 - DNA, 22 bp, Artificial Sequence
  chemically synthesized
gctaaatgaccctgcctgtgat

SEQ ID NO: 1407259 - DNA, 22 bp, Artificial Sequence
  chemically synthesized
attgatacatcacaggcagggt

SEQ ID NO: 1407260 - DNA, 22 bp, Artificial Sequence
  chemically synthesized
atacatcacaggcagggtcatt

SEQ ID NO: 1407261 - DNA, 22 bp, Artificial Sequence
  chemically synthesized
gtcaataaatcagctggctaaa

SEQ ID NO: 1407262 - DNA, 22 bp, Artificial Sequence
  chemically synthesized
acataagagtctggtcaataaa

SEQ ID NO: 1407263 - DNA, 22 bp, Artificial Sequence
  chemically synthesized
gacataagagtctggtcaataa

SEQ ID NO: 1407264 - DNA, 22 bp, Artificial Sequence
  chemically synthesized
agccagctgatttattgaccag

SEQ ID NO: 1407265 - DNA, 22 bp, Artificial Sequence
  chemically synthesized
gccagctgatttattgaccaga

SEQ ID NO: 1407266 - DNA, 22 bp, Artificial Sequence
  chemically synthesized
tttgacataagagtctggtcaa

SEQ ID NO: 1407267 - DNA, 22 bp, Artificial Sequence
  chemically synthesized
ctgtttgacataagagtctggt

SEQ ID NO: 1407268 - DNA, 22 bp, Artificial Sequence
  chemically synthesized
gctgtttgacataagagtctgg

SEQ ID NO: 1407269 - DNA, 22 bp, Artificial Sequence
  chemically synthesized
atttattgaccagactcttatg

SEQ ID NO: 1407270 - DNA, 22 bp, Artificial Sequence
  chemically synthesized
attgaccagactcttatgtcaa

SEQ ID NO: 1407271 - DNA, 22 bp, Artificial Sequence
  chemically synthesized
ttgaccagactcttatgtcaaa

SEQ ID NO: 1407272 - DNA, 22 bp, Artificial Sequence
  chemically synthesized
accagactcttatgtcaaacag

SEQ ID NO: 1407273 - DNA, 22 bp, Artificial Sequence
  chemically synthesized
ttatgtcaaacagcaaatattt

SEQ ID NO: 1407274 - DNA, 22 bp, Artificial Sequence
  chemically synthesized
atgtcaaacagcaaatatttct

SEQ ID NO: 1407275 - DNA, 22 bp, Artificial Sequence
  chemically synthesized
tgtcaaacagcaaatatttctc

SEQ ID NO: 1407276 - DNA, 22 bp, Artificial Sequence
  chemically synthesized
tgatgcccatatggtgaaaatg

SEQ ID NO: 1407277 - DNA, 22 bp, Artificial Sequence
  chemically synthesized
atgatgcccatatggtgaaaat

SEQ ID NO: 1407278 - DNA, 22 bp, Artificial Sequence
  chemically synthesized
tatgatgcccatatggtgaaaa

SEQ ID NO: 1407279 - DNA, 22 bp, Artificial Sequence
  chemically synthesized
ttatgatgcccatatggtgaaa

SEQ ID NO: 1407280 - DNA, 22 bp, Artificial Sequence
  chemically synthesized
ctccattttcaccatatgggca

SEQ ID NO: 1407281 - DNA, 22 bp, Artificial Sequence
  chemically synthesized
tccattttcaccatatgggcat

SEQ ID NO: 1407282 - DNA, 22 bp, Artificial Sequence
  chemically synthesized
cattttcaccatatgggcatca

SEQ ID NO: 1407283 - DNA, 22 bp, Artificial Sequence
  chemically synthesized
gtaaagatttttatgatgccca

SEQ ID NO: 1407284 - DNA, 22 bp, Artificial Sequence
  chemically synthesized
ggtaaagatttttatgatgccc

SEQ ID NO: 1407285 - DNA, 22 bp, Artificial Sequence
  chemically synthesized
tggtaaagatttttatgatgcc

SEQ ID NO: 1407286 - DNA, 22 bp, Artificial Sequence
  chemically synthesized
tcaccatatgggcatcataaaa

SEQ ID NO: 1407287 - DNA, 22 bp, Artificial Sequence
  chemically synthesized
caccatatgggcatcataaaaa

SEQ ID NO: 1407288 - DNA, 22 bp, Artificial Sequence
  chemically synthesized
accatatgggcatcataaaaat

SEQ ID NO: 1407289 - DNA, 22 bp, Artificial Sequence
  chemically synthesized
tagcatggactttggtaaagat

SEQ ID NO: 1407290 - DNA, 22 bp, Artificial Sequence
  chemically synthesized
attatagcatggactttggtaa

SEQ ID NO: 1407291 - DNA, 22 bp, Artificial Sequence
  chemically synthesized
gattatagcatggactttggta

SEQ ID NO: 1407292 - DNA, 22 bp, Artificial Sequence
  chemically synthesized
tcttgattatagcatggacttt

SEQ ID NO: 1407293 - DNA, 22 bp, Artificial Sequence
  chemically synthesized
gttatcttgattatagcatgga

SEQ ID NO: 1407294 - DNA, 22 bp, Artificial Sequence
  chemically synthesized
taccaaagtccatgctataatc

SEQ ID NO: 1407295 - DNA, 22 bp, Artificial Sequence
  chemically synthesized
accaaagtccatgctataatca

SEQ ID NO: 1407296 - DNA, 22 bp, Artificial Sequence
  chemically synthesized
ccaaagtccatgctataatcaa

SEQ ID NO: 1407297 - DNA, 22 bp, Artificial Sequence
  chemically synthesized
aaaagtatgtaatatggctagt

SEQ ID NO: 1407298 - DNA, 22 bp, Artificial Sequence
  chemically synthesized
taatcaagataactagccatat

SEQ ID NO: 1407299 - DNA, 22 bp, Artificial Sequence
  chemically synthesized
tctgaaaagtatgtaatatggc

SEQ ID NO: 1407300 - DNA, 22 bp, Artificial Sequence
  chemically synthesized
caatgttatctgaaaagtatgt

SEQ ID NO: 1407301 - DNA, 22 bp, Artificial Sequence
  chemically synthesized
tccaatgttatctgaaaagtat

SEQ ID NO: 1407302 - DNA, 22 bp, Artificial Sequence
  chemically synthesized
gccatattacatacttttcaga

SEQ ID NO: 1407303 - DNA, 22 bp, Artificial Sequence
  chemically synthesized
tgattctccaatgttatctgaa

SEQ ID NO: 1407304 - DNA, 22 bp, Artificial Sequence
  chemically synthesized
catacttttcagataacattgg

SEQ ID NO: 1407305 - DNA, 22 bp, Artificial Sequence
  chemically synthesized
ttcagataacattggagaatca

SEQ ID NO: 1407306 - DNA, 22 bp, Artificial Sequence
  chemically synthesized
tcagataacattggagaatcac

SEQ ID NO: 1407307 - DNA, 22 bp, Artificial Sequence
  chemically synthesized
cagataacattggagaatcaca

SEQ ID NO: 1407308 - DNA, 22 bp, Artificial Sequence
  chemically synthesized
agataacattggagaatcacag

SEQ ID NO: 1407309 - DNA, 22 bp, Artificial Sequence
  chemically synthesized
gagaatcacagcatatattatc

SEQ ID NO: 1407310 - DNA, 22 bp, Artificial Sequence
  chemically synthesized
gaaagagtgcaaagataatata

SEQ ID NO: 1407311 - DNA, 22 bp, Artificial Sequence
  chemically synthesized
agaaagagtgcaaagataatat

SEQ ID NO: 1407312 - DNA, 22 bp, Artificial Sequence
  chemically synthesized
tctttgcactctttctaaacca

SEQ ID NO: 1407313 - DNA, 22 bp, Artificial Sequence
  chemically synthesized
aagaaggtgagatggtttagaa

SEQ ID NO: 1407314 - DNA, 22 bp, Artificial Sequence
  chemically synthesized
ctgaagaaggtgagatggttta

SEQ ID NO: 1407315 - DNA, 22 bp, Artificial Sequence
  chemically synthesized
tgcactctttctaaaccatctc

SEQ ID NO: 1407316 - DNA, 22 bp, Artificial Sequence
  chemically synthesized
gcactctttctaaaccatctca

SEQ ID NO: 1407317 - DNA, 22 bp, Artificial Sequence
  chemically synthesized
cactctttctaaaccatctcac

SEQ ID NO: 1407318 - DNA, 22 bp, Artificial Sequence
  chemically synthesized
acaattcctgaagaaggtgaga

SEQ ID NO: 1407319 - DNA, 22 bp, Artificial Sequence
  chemically synthesized
tttctaaaccatctcaccttct

SEQ ID NO: 1407320 - DNA, 22 bp, Artificial Sequence
  chemically synthesized
tctaaaccatctcaccttcttc

SEQ ID NO: 1407321 - DNA, 22 bp, Artificial Sequence
  chemically synthesized
ctaaaccatctcaccttcttca

SEQ ID NO: 1407322 - DNA, 22 bp, Artificial Sequence
  chemically synthesized
taaaccatctcaccttcttcag

SEQ ID NO: 1407323 - DNA, 22 bp, Artificial Sequence
  chemically synthesized
aaccatctcaccttcttcagga

SEQ ID NO: 1407324 - DNA, 22 bp, Artificial Sequence
  chemically synthesized
ggagtaactgacaattcctgaa

SEQ ID NO: 1407325 - DNA, 22 bp, Artificial Sequence
  chemically synthesized
actgggagtaactgacaattcc

SEQ ID NO: 1407326 - DNA, 22 bp, Artificial Sequence
  chemically synthesized
cactgggagtaactgacaattc

SEQ ID NO: 1407327 - DNA, 22 bp, Artificial Sequence
  chemically synthesized
accttcttcaggaattgtcagt

SEQ ID NO: 1407328 - DNA, 22 bp, Artificial Sequence
  chemically synthesized
ttcactgggagtaactgacaat

SEQ ID NO: 1407329 - DNA, 22 bp, Artificial Sequence
  chemically synthesized
cttcactgggagtaactgacaa

SEQ ID NO: 1407330 - DNA, 22 bp, Artificial Sequence
  chemically synthesized
tcttcactgggagtaactgaca

SEQ ID NO: 1407331 - DNA, 22 bp, Artificial Sequence
  chemically synthesized
ttcttcactgggagtaactgac

SEQ ID NO: 1407332 - DNA, 22 bp, Artificial Sequence
  chemically synthesized
cttcaggaattgtcagttactc

SEQ ID NO: 1407333 - DNA, 22 bp, Artificial Sequence
  chemically synthesized
tttcttcactgggagtaactga

SEQ ID NO: 1407334 - DNA, 22 bp, Artificial Sequence
  chemically synthesized
ttcaggaattgtcagttactcc

SEQ ID NO: 1407335 - DNA, 22 bp, Artificial Sequence
  chemically synthesized
caggaattgtcagttactccca

SEQ ID NO: 1407336 - DNA, 22 bp, Artificial Sequence
  chemically synthesized
aggaattgtcagttactcccag

SEQ ID NO: 1407337 - DNA, 22 bp, Artificial Sequence
  chemically synthesized
tcagttactcccagtgaagaaa

SEQ ID NO: 1407338 - DNA, 22 bp, Artificial Sequence
  chemically synthesized
ctcccagtgaagaaaaaatatt

SEQ ID NO: 1407339 - DNA, 22 bp, Artificial Sequence
  chemically synthesized
cagaaaaatatgcaatattttt

SEQ ID NO: 1407340 - DNA, 22 bp, Artificial Sequence
  chemically synthesized
ccagaaaaatatgcaatatttt

SEQ ID NO: 1407341 - DNA, 22 bp, Artificial Sequence
  chemically synthesized
ccagtgaagaaaaaatattgca

SEQ ID NO: 1407342 - DNA, 22 bp, Artificial Sequence
  chemically synthesized
tccagaaaaatatgcaatattt

SEQ ID NO: 1407343 - DNA, 22 bp, Artificial Sequence
  chemically synthesized
ttccagaaaaatatgcaatatt

SEQ ID NO: 1407344 - DNA, 22 bp, Artificial Sequence
  chemically synthesized
gaaatatttttccagaaaaata

SEQ ID NO: 1407345 - DNA, 22 bp, Artificial Sequence
  chemically synthesized
aaactggaaatatttttccaga

SEQ ID NO: 1407346 - DNA, 22 bp, Artificial Sequence
  chemically synthesized
aaaactggaaatatttttccag

SEQ ID NO: 1407347 - DNA, 22 bp, Artificial Sequence
  chemically synthesized
catatttttctggaaaaatatt

SEQ ID NO: 1407348 - DNA, 22 bp, Artificial Sequence
  chemically synthesized
cttaaaactggaaatatttttc

SEQ ID NO: 1407349 - DNA, 22 bp, Artificial Sequence
  chemically synthesized
ttctggaaaaatatttccagtt

SEQ ID NO: 1407350 - DNA, 22 bp, Artificial Sequence
  chemically synthesized
tctggaaaaatatttccagttt

SEQ ID NO: 1407351 - DNA, 22 bp, Artificial Sequence
  chemically synthesized
ctggaaaaatatttccagtttt

SEQ ID NO: 1407352 - DNA, 22 bp, Artificial Sequence
  chemically synthesized
tggaaaaatatttccagtttta

SEQ ID NO: 1407353 - DNA, 22 bp, Artificial Sequence
  chemically synthesized
gaaaaatatttccagttttaag

SEQ ID NO: 1407354 - DNA, 22 bp, Artificial Sequence
  chemically synthesized
tggagagtaaataattacttaa

SEQ ID NO: 1407355 - DNA, 22 bp, Artificial Sequence
  chemically synthesized
gattgtggagagtaaataatta

SEQ ID NO: 1407356 - DNA, 22 bp, Artificial Sequence
  chemically synthesized
ccagttttaagtaattatttac

SEQ ID NO: 1407357 - DNA, 22 bp, Artificial Sequence
  chemically synthesized
cagttttaagtaattatttact

SEQ ID NO: 1407358 - DNA, 22 bp, Artificial Sequence
  chemically synthesized
taagtaattatttactctccac

SEQ ID NO: 1407359 - DNA, 22 bp, Artificial Sequence
  chemically synthesized
aagtaattatttactctccaca

SEQ ID NO: 1407360 - DNA, 22 bp, Artificial Sequence
  chemically synthesized
agtaattatttactctccacaa

SEQ ID NO: 1407361 - DNA, 22 bp, Artificial Sequence
  chemically synthesized
tttactctccacaatctaatta

SEQ ID NO: 1407362 - DNA, 22 bp, Artificial Sequence
  chemically synthesized
actctccacaatctaattatgg

SEQ ID NO: 1407363 - DNA, 22 bp, Artificial Sequence
  chemically synthesized
ctctccacaatctaattatgga

SEQ ID NO: 1407364 - DNA, 22 bp, Artificial Sequence
  chemically synthesized
tccacaatctaattatggactt

SEQ ID NO: 1407365 - DNA, 22 bp, Artificial Sequence
  chemically synthesized
cacaatctaattatggactttc

SEQ ID NO: 1407366 - DNA, 22 bp, Artificial Sequence
  chemically synthesized
aagtgaaaaataggaaggaaag

SEQ ID NO: 1407367 - DNA, 22 bp, Artificial Sequence
  chemically synthesized
attatggactttccttcctatt

SEQ ID NO: 1407368 - DNA, 22 bp, Artificial Sequence
  chemically synthesized
tggactttccttcctatttttc

SEQ ID NO: 1407369 - DNA, 22 bp, Artificial Sequence
  chemically synthesized
ataaactaaagtgaaaaatagg

SEQ ID NO: 1407370 - DNA, 22 bp, Artificial Sequence
  chemically synthesized
gagttaataaactaaagtgaaa

SEQ ID NO: 1407371 - DNA, 22 bp, Artificial Sequence
  chemically synthesized
tccttcctatttttcactttag

SEQ ID NO: 1407372 - DNA, 22 bp, Artificial Sequence
  chemically synthesized
ccttcctatttttcactttagt

SEQ ID NO: 1407373 - DNA, 22 bp, Artificial Sequence
  chemically synthesized
cttcctatttttcactttagtt

SEQ ID NO: 1407374 - DNA, 22 bp, Artificial Sequence
  chemically synthesized
cctatttttcactttagtttat

SEQ ID NO: 1407375 - DNA, 22 bp, Artificial Sequence
  chemically synthesized
gtcctggagttaataaactaaa

SEQ ID NO: 1407376 - DNA, 22 bp, Artificial Sequence
  chemically synthesized
ctatttttcactttagtttatt

SEQ ID NO: 1407377 - DNA, 22 bp, Artificial Sequence
  chemically synthesized
tttttcactttagtttattaac

SEQ ID NO: 1407378 - DNA, 22 bp, Artificial Sequence
  chemically synthesized
gttggtcctggagttaataaac

SEQ ID NO: 1407379 - DNA, 22 bp, Artificial Sequence
  chemically synthesized
agttggtcctggagttaataaa

SEQ ID NO: 1407380 - DNA, 22 bp, Artificial Sequence
  chemically synthesized
tagttggtcctggagttaataa

SEQ ID NO: 1407381 - DNA, 22 bp, Artificial Sequence
  chemically synthesized
ttcactttagtttattaactcc

SEQ ID NO: 1407382 - DNA, 22 bp, Artificial Sequence
  chemically synthesized
tcactttagtttattaactcca

SEQ ID NO: 1407383 - DNA, 22 bp, Artificial Sequence
  chemically synthesized
cactttagtttattaactccag

SEQ ID NO: 1407384 - DNA, 22 bp, Artificial Sequence
  chemically synthesized
actttagtttattaactccagg

SEQ ID NO: 1407385 - DNA, 22 bp, Artificial Sequence
  chemically synthesized
tagtttattaactccaggacca

SEQ ID NO: 1407386 - DNA, 22 bp, Artificial Sequence
  chemically synthesized
agtttattaactccaggaccaa

SEQ ID NO: 1407387 - DNA, 22 bp, Artificial Sequence
  chemically synthesized
gtttattaactccaggaccaac

SEQ ID NO: 1407388 - DNA, 22 bp, Artificial Sequence
  chemically synthesized
attaactccaggaccaactaaa

SEQ ID NO: 1407389 - DNA, 22 bp, Artificial Sequence
  chemically synthesized
ttaactccaggaccaactaaaa

SEQ ID NO: 1407390 - DNA, 22 bp, Artificial Sequence
  chemically synthesized
actccaggaccaactaaaatat

SEQ ID NO: 1407391 - DNA, 22 bp, Artificial Sequence
  chemically synthesized
caggaccaactaaaatattgtc

SEQ ID NO: 1407392 - DNA, 22 bp, Artificial Sequence
  chemically synthesized
aaaagagaaagccacgacaata

SEQ ID NO: 1407393 - DNA, 22 bp, Artificial Sequence
  chemically synthesized
aaaaagagaaagccacgacaat

SEQ ID NO: 1407394 - DNA, 22 bp, Artificial Sequence
  chemically synthesized
tttaaaaagagaaagccacgac

SEQ ID NO: 1407395 - DNA, 22 bp, Artificial Sequence
  chemically synthesized
aaatattgtcgtggctttctct

SEQ ID NO: 1407396 - DNA, 22 bp, Artificial Sequence
  chemically synthesized
tcgtggctttctctttttaaac

SEQ ID NO: 1407397 - DNA, 22 bp, Artificial Sequence
  chemically synthesized
tctctttttaaacagttctgac

SEQ ID NO: 1407398 - DNA, 22 bp, Artificial Sequence
  chemically synthesized
ctctttttaaacagttctgact

SEQ ID NO: 1407399 - DNA, 22 bp, Artificial Sequence
  chemically synthesized
gaaaaaaaaaaaagtcagaact

SEQ ID NO: 1407400 - DNA, 22 bp, Artificial Sequence
  chemically synthesized
tctttttaaacagttctgactt

SEQ ID NO: 1407401 - DNA, 22 bp, Artificial Sequence
  chemically synthesized
ggaaaaaaaaaaaagtcagaac

SEQ ID NO: 1407402 - DNA, 22 bp, Artificial Sequence
  chemically synthesized
tggaaaaaaaaaaaagtcagaa

SEQ ID NO: 1407403 - DNA, 22 bp, Artificial Sequence
  chemically synthesized
tttttaaacagttctgactttt

SEQ ID NO: 1407404 - DNA, 22 bp, Artificial Sequence
  chemically synthesized
tttaaacagttctgactttttt

SEQ ID NO: 1407405 - DNA, 22 bp, Artificial Sequence
  chemically synthesized
ttaaacagttctgacttttttt

SEQ ID NO: 1407406 - DNA, 22 bp, Artificial Sequence
  chemically synthesized
taaacagttctgactttttttt

SEQ ID NO: 1407407 - DNA, 22 bp, Artificial Sequence
  chemically synthesized
aaacagttctgacttttttttt

SEQ ID NO: 1407408 - DNA, 22 bp, Artificial Sequence
  chemically synthesized
aacagttctgactttttttttt

SEQ ID NO: 1407409 - DNA, 22 bp, Artificial Sequence
  chemically synthesized
tgacttttttttttttccaaag

SEQ ID NO: 1407410 - DNA, 22 bp, Artificial Sequence
  chemically synthesized
acttttttttttttccaaagcg

SEQ ID NO: 1407411 - DNA, 22 bp, Artificial Sequence
  chemically synthesized
ttttttttttccaaagcgtgtg

SEQ ID NO: 1407412 - DNA, 22 bp, Artificial Sequence
  chemically synthesized
tttttttttccaaagcgtgtgt

SEQ ID NO: 1407413 - DNA, 22 bp, Artificial Sequence
  chemically synthesized
ttttttttccaaagcgtgtgtg

SEQ ID NO: 1407414 - DNA, 22 bp, Artificial Sequence
  chemically synthesized
tttttttccaaagcgtgtgtgt

SEQ ID NO: 1407415 - DNA, 22 bp, Artificial Sequence
  chemically synthesized
ttttttccaaagcgtgtgtgtg

SEQ ID NO: 1407416 - DNA, 22 bp, Artificial Sequence
  chemically synthesized
tttttccaaagcgtgtgtgtgt

SEQ ID NO: 1407417 - DNA, 22 bp, Artificial Sequence
  chemically synthesized
ttttccaaagcgtgtgtgtgtg

SEQ ID NO: 1407418 - DNA, 22 bp, Artificial Sequence
  chemically synthesized
tttccaaagcgtgtgtgtgtgt

SEQ ID NO: 1407419 - DNA, 22 bp, Artificial Sequence
  chemically synthesized
ttccaaagcgtgtgtgtgtgtg

SEQ ID NO: 1407420 - DNA, 22 bp, Artificial Sequence
  chemically synthesized
tccaaagcgtgtgtgtgtgtgt

SEQ ID NO: 1407421 - DNA, 22 bp, Artificial Sequence
  chemically synthesized
ccaaagcgtgtgtgtgtgtgtg

SEQ ID NO: 1407422 - DNA, 22 bp, Artificial Sequence
  chemically synthesized
caaagcgtgtgtgtgtgtgtgt

SEQ ID NO: 1407423 - DNA, 22 bp, Artificial Sequence
  chemically synthesized
agcatgtgcatacacacacaca

SEQ ID NO: 1407424 - DNA, 22 bp, Artificial Sequence
  chemically synthesized
aagcatgtgcatacacacacac

SEQ ID NO: 1407425 - DNA, 22 bp, Artificial Sequence
  chemically synthesized
agaaggaaaaagcaaataaaaa

SEQ ID NO: 1407426 - DNA, 22 bp, Artificial Sequence
  chemically synthesized
aagaaggaaaaagcaaataaaa

SEQ ID NO: 1407427 - DNA, 22 bp, Artificial Sequence
  chemically synthesized
aagtggtttgtttttatttgct

SEQ ID NO: 1407428 - DNA, 22 bp, Artificial Sequence
  chemically synthesized
taagaaggaaaaagcaaataaa

SEQ ID NO: 1407429 - DNA, 22 bp, Artificial Sequence
  chemically synthesized
agtggtttgtttttatttgctt

SEQ ID NO: 1407430 - DNA, 22 bp, Artificial Sequence
  chemically synthesized
ttaagaaggaaaaagcaaataa

SEQ ID NO: 1407431 - DNA, 22 bp, Artificial Sequence
  chemically synthesized
gtttttatttgctttttccttc

SEQ ID NO: 1407432 - DNA, 22 bp, Artificial Sequence
  chemically synthesized
tttttatttgctttttccttct

SEQ ID NO: 1407433 - DNA, 22 bp, Artificial Sequence
  chemically synthesized
ttatttgctttttccttcttaa

SEQ ID NO: 1407434 - DNA, 22 bp, Artificial Sequence
  chemically synthesized
tatttgctttttccttcttaaa

SEQ ID NO: 1407435 - DNA, 22 bp, Artificial Sequence
  chemically synthesized
atttgctttttccttcttaaaa

SEQ ID NO: 1407436 - DNA, 22 bp, Artificial Sequence
  chemically synthesized
atataatccatcttttaagaag

SEQ ID NO: 1407437 - DNA, 22 bp, Artificial Sequence
  chemically synthesized
tttgctttttccttcttaaaag

SEQ ID NO: 1407438 - DNA, 22 bp, Artificial Sequence
  chemically synthesized
tcatataatccatcttttaaga

SEQ ID NO: 1407439 - DNA, 22 bp, Artificial Sequence
  chemically synthesized
gctttttccttcttaaaagatg

SEQ ID NO: 1407440 - DNA, 22 bp, Artificial Sequence
  chemically synthesized
ctttttccttcttaaaagatgg

SEQ ID NO: 1407441 - DNA, 22 bp, Artificial Sequence
  chemically synthesized
tttccttcttaaaagatggatt

SEQ ID NO: 1407442 - DNA, 22 bp, Artificial Sequence
  chemically synthesized
ccattctcatataatccatctt

SEQ ID NO: 1407443 - DNA, 22 bp, Artificial Sequence
  chemically synthesized
ttccttcttaaaagatggatta

SEQ ID NO: 1407444 - DNA, 22 bp, Artificial Sequence
  chemically synthesized
tccttcttaaaagatggattat

SEQ ID NO: 1407445 - DNA, 22 bp, Artificial Sequence
  chemically synthesized
ccttcttaaaagatggattata

SEQ ID NO: 1407446 - DNA, 22 bp, Artificial Sequence
  chemically synthesized
cttcttaaaagatggattatat

SEQ ID NO: 1407447 - DNA, 22 bp, Artificial Sequence
  chemically synthesized
tcctcccattctcatataatcc

SEQ ID NO: 1407448 - DNA, 22 bp, Artificial Sequence
  chemically synthesized
cttaaaagatggattatatgag

SEQ ID NO: 1407449 - DNA, 22 bp, Artificial Sequence
  chemically synthesized
ttaaaagatggattatatgaga

SEQ ID NO: 1407450 - DNA, 22 bp, Artificial Sequence
  chemically synthesized
ttatcctcccattctcatataa

SEQ ID NO: 1407451 - DNA, 22 bp, Artificial Sequence
  chemically synthesized
aaaagatggattatatgagaat

SEQ ID NO: 1407452 - DNA, 22 bp, Artificial Sequence
  chemically synthesized
aaagatggattatatgagaatg

SEQ ID NO: 1407453 - DNA, 22 bp, Artificial Sequence
  chemically synthesized
catcctattatcctcccattct

SEQ ID NO: 1407454 - DNA, 22 bp, Artificial Sequence
  chemically synthesized
ctccatcctattatcctcccat

SEQ ID NO: 1407455 - DNA, 22 bp, Artificial Sequence
  chemically synthesized
gctccatcctattatcctccca

SEQ ID NO: 1407456 - DNA, 22 bp, Artificial Sequence
  chemically synthesized
tatgagaatgggaggataatag

SEQ ID NO: 1407457 - DNA, 22 bp, Artificial Sequence
  chemically synthesized
agaagcttgctccatcctatta

SEQ ID NO: 1407458 - DNA, 22 bp, Artificial Sequence
  chemically synthesized
cctgagaagcttgctccatcct

SEQ ID NO: 1407459 - DNA, 22 bp, Artificial Sequence
  chemically synthesized
gcctgagaagcttgctccatcc

SEQ ID NO: 1407460 - DNA, 22 bp, Artificial Sequence
  chemically synthesized
tgcctgagaagcttgctccatc

SEQ ID NO: 1407461 - DNA, 22 bp, Artificial Sequence
  chemically synthesized
aaatgttttgcctgagaagctt

SEQ ID NO: 1407462 - DNA, 22 bp, Artificial Sequence
  chemically synthesized
gaaatgttttgcctgagaagct

SEQ ID NO: 1407463 - DNA, 22 bp, Artificial Sequence
  chemically synthesized
tgaaatgttttgcctgagaagc

SEQ ID NO: 1407464 - DNA, 22 bp, Artificial Sequence
  chemically synthesized
agaaatatgctttgaaatgttt

SEQ ID NO: 1407465 - DNA, 22 bp, Artificial Sequence
  chemically synthesized
ctcaggcaaaacatttcaaagc

SEQ ID NO: 1407466 - DNA, 22 bp, Artificial Sequence
  chemically synthesized
tcaggcaaaacatttcaaagca

SEQ ID NO: 1407467 - DNA, 22 bp, Artificial Sequence
  chemically synthesized
aggcaaaacatttcaaagcata

SEQ ID NO: 1407468 - DNA, 22 bp, Artificial Sequence
  chemically synthesized
tcggttaagaaatatgctttga

SEQ ID NO: 1407469 - DNA, 22 bp, Artificial Sequence
  chemically synthesized
caaagcatatttcttaaccgat

SEQ ID NO: 1407470 - DNA, 22 bp, Artificial Sequence
  chemically synthesized
aaagcatatttcttaaccgata

SEQ ID NO: 1407471 - DNA, 22 bp, Artificial Sequence
  chemically synthesized
cttaaccgatagtgtcttcccc

SEQ ID NO: 1407472 - DNA, 22 bp, Artificial Sequence
  chemically synthesized
ttaaccgatagtgtcttcccct

SEQ ID NO: 1407473 - DNA, 22 bp, Artificial Sequence
  chemically synthesized
agaaagatgagcaggggaagac

SEQ ID NO: 1407474 - DNA, 22 bp, Artificial Sequence
  chemically synthesized
cagaaagatgagcaggggaaga

SEQ ID NO: 1407475 - DNA, 22 bp, Artificial Sequence
  chemically synthesized
aaccgatagtgtcttcccctgc

SEQ ID NO: 1407476 - DNA, 22 bp, Artificial Sequence
  chemically synthesized
accgatagtgtcttcccctgct

SEQ ID NO: 1407477 - DNA, 22 bp, Artificial Sequence
  chemically synthesized
ttcagaaagatgagcaggggaa

SEQ ID NO: 1407478 - DNA, 22 bp, Artificial Sequence
  chemically synthesized
ctcttcagaaagatgagcaggg

SEQ ID NO: 1407479 - DNA, 22 bp, Artificial Sequence
  chemically synthesized
aggtgttgctcttcagaaagat

SEQ ID NO: 1407480 - DNA, 22 bp, Artificial Sequence
  chemically synthesized
tcaggtgttgctcttcagaaag

SEQ ID NO: 1407481 - DNA, 22 bp, Artificial Sequence
  chemically synthesized
cccctgctcatctttctgaaga

SEQ ID NO: 1407482 - DNA, 22 bp, Artificial Sequence
  chemically synthesized
ccctgctcatctttctgaagag

SEQ ID NO: 1407483 - DNA, 22 bp, Artificial Sequence
  chemically synthesized
cctctcaggtgttgctcttcag

SEQ ID NO: 1407484 - DNA, 22 bp, Artificial Sequence
  chemically synthesized
ctcatctttctgaagagcaaca

SEQ ID NO: 1407485 - DNA, 22 bp, Artificial Sequence
  chemically synthesized
atctttctgaagagcaacacct

SEQ ID NO: 1407486 - DNA, 22 bp, Artificial Sequence
  chemically synthesized
gagtagctgcctctcaggtgtt

SEQ ID NO: 1407487 - DNA, 22 bp, Artificial Sequence
  chemically synthesized
tctgaagagcaacacctgagag

SEQ ID NO: 1407488 - DNA, 22 bp, Artificial Sequence
  chemically synthesized
ctgaagagcaacacctgagagg

SEQ ID NO: 1407489 - DNA, 22 bp, Artificial Sequence
  chemically synthesized
tgaagagcaacacctgagaggc

SEQ ID NO: 1407490 - DNA, 22 bp, Artificial Sequence
  chemically synthesized
aagagcaacacctgagaggcag

SEQ ID NO: 1407491 - DNA, 22 bp, Artificial Sequence
  chemically synthesized
ccacatgagctagagtagctgc

SEQ ID NO: 1407492 - DNA, 22 bp, Artificial Sequence
  chemically synthesized
cccacatgagctagagtagctg

SEQ ID NO: 1407493 - DNA, 22 bp, Artificial Sequence
  chemically synthesized
agaggcagctactctagctcat

SEQ ID NO: 1407494 - DNA, 22 bp, Artificial Sequence
  chemically synthesized
tcaagtgaaatttcccacatga

SEQ ID NO: 1407495 - DNA, 22 bp, Artificial Sequence
  chemically synthesized
ctctagctcatgtgggaaattt

SEQ ID NO: 1407496 - DNA, 22 bp, Artificial Sequence
  chemically synthesized
tagctcatgtgggaaatttcac

SEQ ID NO: 1407497 - DNA, 22 bp, Artificial Sequence
  chemically synthesized
gctcatgtgggaaatttcactt

SEQ ID NO: 1407498 - DNA, 22 bp, Artificial Sequence
  chemically synthesized
tgataagactgtcaagtgaaat

SEQ ID NO: 1407499 - DNA, 22 bp, Artificial Sequence
  chemically synthesized
gtgataagactgtcaagtgaaa

SEQ ID NO: 1407500 - DNA, 22 bp, Artificial Sequence
  chemically synthesized
tgtgataagactgtcaagtgaa

SEQ ID NO: 1407501 - DNA, 22 bp, Artificial Sequence
  chemically synthesized
atgtgggaaatttcacttgaca

SEQ ID NO: 1407502 - DNA, 22 bp, Artificial Sequence
  chemically synthesized
ttgtgataagactgtcaagtga

SEQ ID NO: 1407503 - DNA, 22 bp, Artificial Sequence
  chemically synthesized
tttgtgataagactgtcaagtg

SEQ ID NO: 1407504 - DNA, 22 bp, Artificial Sequence
  chemically synthesized
tttttgtgataagactgtcaag

SEQ ID NO: 1407505 - DNA, 22 bp, Artificial Sequence
  chemically synthesized
tctttttgtgataagactgtca

SEQ ID NO: 1407506 - DNA, 22 bp, Artificial Sequence
  chemically synthesized
ctctttttgtgataagactgtc

SEQ ID NO: 1407507 - DNA, 22 bp, Artificial Sequence
  chemically synthesized
tttctctttttgtgataagact

SEQ ID NO: 1407508 - DNA, 22 bp, Artificial Sequence
  chemically synthesized
atttctctttttgtgataagac

SEQ ID NO: 1407509 - DNA, 22 bp, Artificial Sequence
  chemically synthesized
cacttgacagtcttatcacaaa

SEQ ID NO: 1407510 - DNA, 22 bp, Artificial Sequence
  chemically synthesized
acttgacagtcttatcacaaaa

SEQ ID NO: 1407511 - DNA, 22 bp, Artificial Sequence
  chemically synthesized
ccttatttctctttttgtgata

SEQ ID NO: 1407512 - DNA, 22 bp, Artificial Sequence
  chemically synthesized
gacagtcttatcacaaaaagag

SEQ ID NO: 1407513 - DNA, 22 bp, Artificial Sequence
  chemically synthesized
acagtcttatcacaaaaagaga

SEQ ID NO: 1407514 - DNA, 22 bp, Artificial Sequence
  chemically synthesized
atcacaaaaagagaaataaggg

SEQ ID NO: 1407515 - DNA, 22 bp, Artificial Sequence
  chemically synthesized
tcacaaaaagagaaataaggga

SEQ ID NO: 1407516 - DNA, 22 bp, Artificial Sequence
  chemically synthesized
agtaaaaaaatctcccttattt

SEQ ID NO: 1407517 - DNA, 22 bp, Artificial Sequence
  chemically synthesized
aagtaaaaaaatctcccttatt

SEQ ID NO: 1407518 - DNA, 22 bp, Artificial Sequence
  chemically synthesized
taagtaaaaaaatctcccttat

SEQ ID NO: 1407519 - DNA, 22 bp, Artificial Sequence
  chemically synthesized
ttaagtaaaaaaatctccctta

SEQ ID NO: 1407520 - DNA, 22 bp, Artificial Sequence
  chemically synthesized
tttaagtaaaaaaatctccctt

SEQ ID NO: 1407521 - DNA, 22 bp, Artificial Sequence
  chemically synthesized
ttttttaagtaaaaaaatctcc

SEQ ID NO: 1407522 - DNA, 22 bp, Artificial Sequence
  chemically synthesized
agcatcattattttttaagtaa

SEQ ID NO: 1407523 - DNA, 22 bp, Artificial Sequence
  chemically synthesized
ttgagcatcattattttttaag

SEQ ID NO: 1407524 - DNA, 22 bp, Artificial Sequence
  chemically synthesized
attgagcatcattattttttaa

SEQ ID NO: 1407525 - DNA, 22 bp, Artificial Sequence
  chemically synthesized
tattgagcatcattatttttta

SEQ ID NO: 1407526 - DNA, 22 bp, Artificial Sequence
  chemically synthesized
ttttacttaaaaaataatgatg

SEQ ID NO: 1407527 - DNA, 22 bp, Artificial Sequence
  chemically synthesized
tttacttaaaaaataatgatgc

SEQ ID NO: 1407528 - DNA, 22 bp, Artificial Sequence
  chemically synthesized
ttacttaaaaaataatgatgct

SEQ ID NO: 1407529 - DNA, 22 bp, Artificial Sequence
  chemically synthesized
tacttaaaaaataatgatgctc

SEQ ID NO: 1407530 - DNA, 22 bp, Artificial Sequence
  chemically synthesized
acttaaaaaataatgatgctca

SEQ ID NO: 1407531 - DNA, 22 bp, Artificial Sequence
  chemically synthesized
cttaaaaaataatgatgctcaa

SEQ ID NO: 1407532 - DNA, 22 bp, Artificial Sequence
  chemically synthesized
ggtaaaaattttattgagcatc

SEQ ID NO: 1407533 - DNA, 22 bp, Artificial Sequence
  chemically synthesized
aggtaaaaattttattgagcat

SEQ ID NO: 1407534 - DNA, 22 bp, Artificial Sequence
  chemically synthesized
aaaaaataatgatgctcaataa

SEQ ID NO: 1407535 - DNA, 22 bp, Artificial Sequence
  chemically synthesized
taggtaaaaattttattgagca

SEQ ID NO: 1407536 - DNA, 22 bp, Artificial Sequence
  chemically synthesized
aaaaataatgatgctcaataaa

SEQ ID NO: 1407537 - DNA, 22 bp, Artificial Sequence
  chemically synthesized
ttaggtaaaaattttattgagc

SEQ ID NO: 1407538 - DNA, 22 bp, Artificial Sequence
  chemically synthesized
ttttaggtaaaaattttattga

SEQ ID NO: 1407539 - DNA, 22 bp, Artificial Sequence
  chemically synthesized
tctcttttaggtaaaaatttta

SEQ ID NO: 1407540 - DNA, 22 bp, Artificial Sequence
  chemically synthesized
atctcttttaggtaaaaatttt

SEQ ID NO: 1407541 - DNA, 22 bp, Artificial Sequence
  chemically synthesized
tttatctcttttaggtaaaaat

SEQ ID NO: 1407542 - DNA, 22 bp, Artificial Sequence
  chemically synthesized
aataaaatttttacctaaaaga

SEQ ID NO: 1407543 - DNA, 22 bp, Artificial Sequence
  chemically synthesized
aaacaattatttatctctttta

SEQ ID NO: 1407544 - DNA, 22 bp, Artificial Sequence
  chemically synthesized
taaaacaattatttatctcttt

SEQ ID NO: 1407545 - DNA, 22 bp, Artificial Sequence
  chemically synthesized
ttacctaaaagagataaataat

SEQ ID NO: 1407546 - DNA, 22 bp, Artificial Sequence
  chemically synthesized
tattctaaaacaattatttatc

SEQ ID NO: 1407547 - DNA, 22 bp, Artificial Sequence
  chemically synthesized
tacctaaaagagataaataatt

SEQ ID NO: 1407548 - DNA, 22 bp, Artificial Sequence
  chemically synthesized
atattctaaaacaattatttat

SEQ ID NO: 1407549 - DNA, 22 bp, Artificial Sequence
  chemically synthesized
acctaaaagagataaataattg

SEQ ID NO: 1407550 - DNA, 22 bp, Artificial Sequence
  chemically synthesized
cctaaaagagataaataattgt

SEQ ID NO: 1407551 - DNA, 22 bp, Artificial Sequence
  chemically synthesized
aaagagataaataattgtttta

SEQ ID NO: 1407552 - DNA, 22 bp, Artificial Sequence
  chemically synthesized
aggcatttatattctaaaacaa

SEQ ID NO: 1407553 - DNA, 22 bp, Artificial Sequence
  chemically synthesized
taaggcatttatattctaaaac

SEQ ID NO: 1407554 - DNA, 22 bp, Artificial Sequence
  chemically synthesized
tctaaggcatttatattctaaa

SEQ ID NO: 1407555 - DNA, 22 bp, Artificial Sequence
  chemically synthesized
ctctaaggcatttatattctaa

SEQ ID NO: 1407556 - DNA, 22 bp, Artificial Sequence
  chemically synthesized
tctctaaggcatttatattcta

SEQ ID NO: 1407557 - DNA, 22 bp, Artificial Sequence
  chemically synthesized
ttttctctaaggcatttatatt

SEQ ID NO: 1407558 - DNA, 22 bp, Artificial Sequence
  chemically synthesized
ttttagaatataaatgccttag

SEQ ID NO: 1407559 - DNA, 22 bp, Artificial Sequence
  chemically synthesized
agattgttttctctaaggcatt

SEQ ID NO: 1407560 - DNA, 22 bp, Artificial Sequence
  chemically synthesized
tagaatataaatgccttagaga

SEQ ID NO: 1407561 - DNA, 22 bp, Artificial Sequence
  chemically synthesized
agaatataaatgccttagagaa

SEQ ID NO: 1407562 - DNA, 22 bp, Artificial Sequence
  chemically synthesized
gaatataaatgccttagagaaa

SEQ ID NO: 1407563 - DNA, 22 bp, Artificial Sequence
  chemically synthesized
aaactcagattgttttctctaa

SEQ ID NO: 1407564 - DNA, 22 bp, Artificial Sequence
  chemically synthesized
tcaaactcagattgttttctct

SEQ ID NO: 1407565 - DNA, 22 bp, Artificial Sequence
  chemically synthesized
tctcaaactcagattgttttct

SEQ ID NO: 1407566 - DNA, 22 bp, Artificial Sequence
  chemically synthesized
cccaattctctcaaactcagat

SEQ ID NO: 1407567 - DNA, 22 bp, Artificial Sequence
  chemically synthesized
ccccaattctctcaaactcaga

SEQ ID NO: 1407568 - DNA, 22 bp, Artificial Sequence
  chemically synthesized
agagaaaacaatctgagtttga

SEQ ID NO: 1407569 - DNA, 22 bp, Artificial Sequence
  chemically synthesized
tccccaattctctcaaactcag

SEQ ID NO: 1407570 - DNA, 22 bp, Artificial Sequence
  chemically synthesized
gagaaaacaatctgagtttgag

SEQ ID NO: 1407571 - DNA, 22 bp, Artificial Sequence
  chemically synthesized
tgtgagttttccccaattctct

SEQ ID NO: 1407572 - DNA, 22 bp, Artificial Sequence
  chemically synthesized
agtttgagagaattggggaaaa

SEQ ID NO: 1407573 - DNA, 22 bp, Artificial Sequence
  chemically synthesized
taaatctatgtgagttttcccc

SEQ ID NO: 1407574 - DNA, 22 bp, Artificial Sequence
  chemically synthesized
ataaatctatgtgagttttccc

SEQ ID NO: 1407575 - DNA, 22 bp, Artificial Sequence
  chemically synthesized
tataaatctatgtgagttttcc

SEQ ID NO: 1407576 - DNA, 22 bp, Artificial Sequence
  chemically synthesized
gagagaattggggaaaactcac

SEQ ID NO: 1407577 - DNA, 22 bp, Artificial Sequence
  chemically synthesized
ttataaatctatgtgagttttc

SEQ ID NO: 1407578 - DNA, 22 bp, Artificial Sequence
  chemically synthesized
agagaattggggaaaactcaca

SEQ ID NO: 1407579 - DNA, 22 bp, Artificial Sequence
  chemically synthesized
gtgacttttataaatctatgtg

SEQ ID NO: 1407580 - DNA, 22 bp, Artificial Sequence
  chemically synthesized
gggaaaactcacatagatttat

SEQ ID NO: 1407581 - DNA, 22 bp, Artificial Sequence
  chemically synthesized
aatccagaattagtgactttta

SEQ ID NO: 1407582 - DNA, 22 bp, Artificial Sequence
  chemically synthesized
acatagatttataaaagtcact

SEQ ID NO: 1407583 - DNA, 22 bp, Artificial Sequence
  chemically synthesized
aaatccagaattagtgactttt

SEQ ID NO: 1407584 - DNA, 22 bp, Artificial Sequence
  chemically synthesized
taaatccagaattagtgacttt

SEQ ID NO: 1407585 - DNA, 22 bp, Artificial Sequence
  chemically synthesized
ttaaatccagaattagtgactt

SEQ ID NO: 1407586 - DNA, 22 bp, Artificial Sequence
  chemically synthesized
ataaaagtcactaattctggat

SEQ ID NO: 1407587 - DNA, 22 bp, Artificial Sequence
  chemically synthesized
atatatttttaaatccagaatt

SEQ ID NO: 1407588 - DNA, 22 bp, Artificial Sequence
  chemically synthesized
taaaagtcactaattctggatt

SEQ ID NO: 1407589 - DNA, 22 bp, Artificial Sequence
  chemically synthesized
aatatatttttaaatccagaat

SEQ ID NO: 1407590 - DNA, 22 bp, Artificial Sequence
  chemically synthesized
taatatatttttaaatccagaa

SEQ ID NO: 1407591 - DNA, 22 bp, Artificial Sequence
  chemically synthesized
caaacattttaatatattttta

SEQ ID NO: 1407592 - DNA, 22 bp, Artificial Sequence
  chemically synthesized
attctggatttaaaaatatatt

SEQ ID NO: 1407593 - DNA, 22 bp, Artificial Sequence
  chemically synthesized
tggatttaaaaatatattaaaa

SEQ ID NO: 1407594 - DNA, 22 bp, Artificial Sequence
  chemically synthesized
gatttaaaaatatattaaaatg

SEQ ID NO: 1407595 - DNA, 22 bp, Artificial Sequence
  chemically synthesized
aaaaatatattaaaatgtttgc

SEQ ID NO: 1407596 - DNA, 22 bp, Artificial Sequence
  chemically synthesized
aaaatatattaaaatgtttgca

SEQ ID NO: 1407597 - DNA, 22 bp, Artificial Sequence
  chemically synthesized
aaatgtttgcagtctatttcat

SEQ ID NO: 1407598 - DNA, 22 bp, Artificial Sequence
  chemically synthesized
gcagtctatttcattgtgtccc

SEQ ID NO: 1407599 - DNA, 22 bp, Artificial Sequence
  chemically synthesized
cagtctatttcattgtgtccca

SEQ ID NO: 1407600 - DNA, 22 bp, Artificial Sequence
  chemically synthesized
tttcattgtgtcccacttctct

SEQ ID NO: 1407601 - DNA, 22 bp, Artificial Sequence
  chemically synthesized
cattgtgtcccacttctctttc

SEQ ID NO: 1407602 - DNA, 22 bp, Artificial Sequence
  chemically synthesized
attgtgtcccacttctctttca

SEQ ID NO: 1407603 - DNA, 22 bp, Artificial Sequence
  chemically synthesized
tgtcccacttctctttcacacc

SEQ ID NO: 1407604 - DNA, 22 bp, Artificial Sequence
  chemically synthesized
ctctttcacaccttctattttt

SEQ ID NO: 1407605 - DNA, 22 bp, Artificial Sequence
  chemically synthesized
tctttcacaccttctattttta

SEQ ID NO: 1407606 - DNA, 22 bp, Artificial Sequence
  chemically synthesized
tttcacaccttctatttttatg

SEQ ID NO: 1407607 - DNA, 22 bp, Artificial Sequence
  chemically synthesized
tcacaccttctatttttatgca

SEQ ID NO: 1407608 - DNA, 22 bp, Artificial Sequence
  chemically synthesized
cacaccttctatttttatgcat

SEQ ID NO: 1407609 - DNA, 22 bp, Artificial Sequence
  chemically synthesized
acaccttctatttttatgcatt

SEQ ID NO: 1407610 - DNA, 22 bp, Artificial Sequence
  chemically synthesized
ctatttttatgcatttctcctt

SEQ ID NO: 1407611 - DNA, 22 bp, Artificial Sequence
  chemically synthesized
tatttttatgcatttctccttc

SEQ ID NO: 1407612 - DNA, 22 bp, Artificial Sequence
  chemically synthesized
tttttatgcatttctccttcat

SEQ ID NO: 1407613 - DNA, 22 bp, Artificial Sequence
  chemically synthesized
aggaagaaaaaacgatgaagga

SEQ ID NO: 1407614 - DNA, 22 bp, Artificial Sequence
  chemically synthesized
ttatgcatttctccttcatcgt

SEQ ID NO: 1407615 - DNA, 22 bp, Artificial Sequence
  chemically synthesized
aaggaagaaaaaacgatgaagg

SEQ ID NO: 1407616 - DNA, 22 bp, Artificial Sequence
  chemically synthesized
tatgcatttctccttcatcgtt

SEQ ID NO: 1407617 - DNA, 22 bp, Artificial Sequence
  chemically synthesized
taaggaagaaaaaacgatgaag

SEQ ID NO: 1407618 - DNA, 22 bp, Artificial Sequence
  chemically synthesized
atgcatttctccttcatcgttt

SEQ ID NO: 1407619 - DNA, 22 bp, Artificial Sequence
  chemically synthesized
tgcatttctccttcatcgtttt

SEQ ID NO: 1407620 - DNA, 22 bp, Artificial Sequence
  chemically synthesized
aagtgctttaaggaagaaaaaa

SEQ ID NO: 1407621 - DNA, 22 bp, Artificial Sequence
  chemically synthesized
ctccttcatcgttttttcttcc

SEQ ID NO: 1407622 - DNA, 22 bp, Artificial Sequence
  chemically synthesized
tccttcatcgttttttcttcct

SEQ ID NO: 1407623 - DNA, 22 bp, Artificial Sequence
  chemically synthesized
tgaagtgctttaaggaagaaaa

SEQ ID NO: 1407624 - DNA, 22 bp, Artificial Sequence
  chemically synthesized
ctgaagtgctttaaggaagaaa

SEQ ID NO: 1407625 - DNA, 22 bp, Artificial Sequence
  chemically synthesized
cttcatcgttttttcttcctta

SEQ ID NO: 1407626 - DNA, 22 bp, Artificial Sequence
  chemically synthesized
catcgttttttcttccttaaag

SEQ ID NO: 1407627 - DNA, 22 bp, Artificial Sequence
  chemically synthesized
atcgttttttcttccttaaagc

SEQ ID NO: 1407628 - DNA, 22 bp, Artificial Sequence
  chemically synthesized
tgtcttctgaagtgctttaagg

SEQ ID NO: 1407629 - DNA, 22 bp, Artificial Sequence
  chemically synthesized
tttcttccttaaagcacttcag

SEQ ID NO: 1407630 - DNA, 22 bp, Artificial Sequence
  chemically synthesized
atcctgtgtcttctgaagtgct

SEQ ID NO: 1407631 - DNA, 22 bp, Artificial Sequence
  chemically synthesized
ttcttccttaaagcacttcaga

SEQ ID NO: 1407632 - DNA, 22 bp, Artificial Sequence
  chemically synthesized
aatcctgtgtcttctgaagtgc

SEQ ID NO: 1407633 - DNA, 22 bp, Artificial Sequence
  chemically synthesized
tcttccttaaagcacttcagaa

SEQ ID NO: 1407634 - DNA, 22 bp, Artificial Sequence
  chemically synthesized
cttccttaaagcacttcagaag

SEQ ID NO: 1407635 - DNA, 22 bp, Artificial Sequence
  chemically synthesized
ttccttaaagcacttcagaaga

SEQ ID NO: 1407636 - DNA, 22 bp, Artificial Sequence
  chemically synthesized
cttaatcctgtgtcttctgaag

SEQ ID NO: 1407637 - DNA, 22 bp, Artificial Sequence
  chemically synthesized
ccttaaagcacttcagaagaca

SEQ ID NO: 1407638 - DNA, 22 bp, Artificial Sequence
  chemically synthesized
cttaaagcacttcagaagacac

SEQ ID NO: 1407639 - DNA, 22 bp, Artificial Sequence
  chemically synthesized
aaagcacttcagaagacacagg

SEQ ID NO: 1407640 - DNA, 22 bp, Artificial Sequence
  chemically synthesized
aagcacttcagaagacacagga

SEQ ID NO: 1407641 - DNA, 22 bp, Artificial Sequence
  chemically synthesized
aaatcccaattgcttaatcctg

SEQ ID NO: 1407642 - DNA, 22 bp, Artificial Sequence
  chemically synthesized
caaatcccaattgcttaatcct

SEQ ID NO: 1407643 - DNA, 22 bp, Artificial Sequence
  chemically synthesized
cagaagacacaggattaagcaa

SEQ ID NO: 1407644 - DNA, 22 bp, Artificial Sequence
  chemically synthesized
agaagacacaggattaagcaat

SEQ ID NO: 1407645 - DNA, 22 bp, Artificial Sequence
  chemically synthesized
agcaattgggatttgaagactt

SEQ ID NO: 1407646 - DNA, 22 bp, Artificial Sequence
  chemically synthesized
ggatttgaagacttcacgtggt

SEQ ID NO: 1407647 - DNA, 22 bp, Artificial Sequence
  chemically synthesized
cagagtgatgagaccacgtgaa

SEQ ID NO: 1407648 - DNA, 22 bp, Artificial Sequence
  chemically synthesized
gaagacttcacgtggtctcatc

SEQ ID NO: 1407649 - DNA, 22 bp, Artificial Sequence
  chemically synthesized
aagacttcacgtggtctcatca

SEQ ID NO: 1407650 - DNA, 22 bp, Artificial Sequence
  chemically synthesized
cacgtggtctcatcactctgca

SEQ ID NO: 1407651 - DNA, 22 bp, Artificial Sequence
  chemically synthesized
acgtggtctcatcactctgcag

SEQ ID NO: 1407652 - DNA, 22 bp, Artificial Sequence
  chemically synthesized
aaacagggtcagcctgcagagt

SEQ ID NO: 1407653 - DNA, 22 bp, Artificial Sequence
  chemically synthesized
taaaacagggtcagcctgcaga

SEQ ID NO: 1407654 - DNA, 22 bp, Artificial Sequence
  chemically synthesized
ctctaaaacagggtcagcctgc

SEQ ID NO: 1407655 - DNA, 22 bp, Artificial Sequence
  chemically synthesized
gctctaaaacagggtcagcctg

SEQ ID NO: 1407656 - DNA, 22 bp, Artificial Sequence
  chemically synthesized
ttgctctaaaacagggtcagcc

SEQ ID NO: 1407657 - DNA, 22 bp, Artificial Sequence
  chemically synthesized
atcactctgcaggctgaccctg

SEQ ID NO: 1407658 - DNA, 22 bp, Artificial Sequence
  chemically synthesized
cttgctctaaaacagggtcagc

SEQ ID NO: 1407659 - DNA, 22 bp, Artificial Sequence
  chemically synthesized
tgcaggctgaccctgttttaga

SEQ ID NO: 1407660 - DNA, 22 bp, Artificial Sequence
  chemically synthesized
caggctgaccctgttttagagc

SEQ ID NO: 1407661 - DNA, 22 bp, Artificial Sequence
  chemically synthesized
ccaatatttcttgctctaaaac

SEQ ID NO: 1407662 - DNA, 22 bp, Artificial Sequence
  chemically synthesized
accctgttttagagcaagaaat

SEQ ID NO: 1407663 - DNA, 22 bp, Artificial Sequence
  chemically synthesized
gaaatgtctgccaatatttctt

SEQ ID NO: 1407664 - DNA, 22 bp, Artificial Sequence
  chemically synthesized
ttttagagcaagaaatattggc

SEQ ID NO: 1407665 - DNA, 22 bp, Artificial Sequence
  chemically synthesized
tagagcaagaaatattggcaga

SEQ ID NO: 1407666 - DNA, 22 bp, Artificial Sequence
  chemically synthesized
agagcaagaaatattggcagac

SEQ ID NO: 1407667 - DNA, 22 bp, Artificial Sequence
  chemically synthesized
gagcaagaaatattggcagaca

SEQ ID NO: 1407668 - DNA, 22 bp, Artificial Sequence
  chemically synthesized
taagagctggaaatgtctgcca

SEQ ID NO: 1407669 - DNA, 22 bp, Artificial Sequence
  chemically synthesized
ataaatgcattgtaagagctgg

SEQ ID NO: 1407670 - DNA, 22 bp, Artificial Sequence
  chemically synthesized
gcagacatttccagctcttaca

SEQ ID NO: 1407671 - DNA, 22 bp, Artificial Sequence
  chemically synthesized
ttgataaatgcattgtaagagc

SEQ ID NO: 1407672 - DNA, 22 bp, Artificial Sequence
  chemically synthesized
attgataaatgcattgtaagag

SEQ ID NO: 1407673 - DNA, 22 bp, Artificial Sequence
  chemically synthesized
ccagctcttacaatgcatttat

SEQ ID NO: 1407674 - DNA, 22 bp, Artificial Sequence
  chemically synthesized
cagctcttacaatgcatttatc

SEQ ID NO: 1407675 - DNA, 22 bp, Artificial Sequence
  chemically synthesized
ttacaatgcatttatcaataag

SEQ ID NO: 1407676 - DNA, 22 bp, Artificial Sequence
  chemically synthesized
acaatgcatttatcaataaggg

SEQ ID NO: 1407677 - DNA, 22 bp, Artificial Sequence
  chemically synthesized
caatgcatttatcaataagggt

SEQ ID NO: 1407678 - DNA, 22 bp, Artificial Sequence
  chemically synthesized
aagagcaggcaaacccttattg

SEQ ID NO: 1407679 - DNA, 22 bp, Artificial Sequence
  chemically synthesized
atcaataagggtttgcctgctc

SEQ ID NO: 1407680 - DNA, 22 bp, Artificial Sequence
  chemically synthesized
tcaataagggtttgcctgctct

SEQ ID NO: 1407681 - DNA, 22 bp, Artificial Sequence
  chemically synthesized
tatgccacgcacctgaagagca

SEQ ID NO: 1407682 - DNA, 22 bp, Artificial Sequence
  chemically synthesized
gcctgctcttcaggtgcgtggc

SEQ ID NO: 1407683 - DNA, 22 bp, Artificial Sequence
  chemically synthesized
cctgctcttcaggtgcgtggca

SEQ ID NO: 1407684 - DNA, 22 bp, Artificial Sequence
  chemically synthesized
ctcttcaggtgcgtggcatata

SEQ ID NO: 1407685 - DNA, 22 bp, Artificial Sequence
  chemically synthesized
ttcaggtgcgtggcatatagac

SEQ ID NO: 1407686 - DNA, 22 bp, Artificial Sequence
  chemically synthesized
atgaaatcgtaaagtctatatg

SEQ ID NO: 1407687 - DNA, 22 bp, Artificial Sequence
  chemically synthesized
caggtgcgtggcatatagactt

SEQ ID NO: 1407688 - DNA, 22 bp, Artificial Sequence
  chemically synthesized
aggtgcgtggcatatagacttt

SEQ ID NO: 1407689 - DNA, 22 bp, Artificial Sequence
  chemically synthesized
ttaatgaaatcgtaaagtctat

SEQ ID NO: 1407690 - DNA, 22 bp, Artificial Sequence
  chemically synthesized
attattaatgaaatcgtaaagt

SEQ ID NO: 1407691 - DNA, 22 bp, Artificial Sequence
  chemically synthesized
ttgattattaatgaaatcgtaa

SEQ ID NO: 1407692 - DNA, 22 bp, Artificial Sequence
  chemically synthesized
tacgatttcattaataatcaac

SEQ ID NO: 1407693 - DNA, 22 bp, Artificial Sequence
  chemically synthesized
acgatttcattaataatcaaca

SEQ ID NO: 1407694 - DNA, 22 bp, Artificial Sequence
  chemically synthesized
ggtggcaccagctgttgattat

SEQ ID NO: 1407695 - DNA, 22 bp, Artificial Sequence
  chemically synthesized
cgatttcattaataatcaacag

SEQ ID NO: 1407696 - DNA, 22 bp, Artificial Sequence
  chemically synthesized
cattaataatcaacagctggtg

SEQ ID NO: 1407697 - DNA, 22 bp, Artificial Sequence
  chemically synthesized
attaataatcaacagctggtgc

SEQ ID NO: 1407698 - DNA, 22 bp, Artificial Sequence
  chemically synthesized
gacagacgctaggtggcaccag

SEQ ID NO: 1407699 - DNA, 22 bp, Artificial Sequence
  chemically synthesized
ataatcaacagctggtgccacc

SEQ ID NO: 1407700 - DNA, 22 bp, Artificial Sequence
  chemically synthesized
atgaatggattggacagacgct

SEQ ID NO: 1407701 - DNA, 22 bp, Artificial Sequence
  chemically synthesized
gtgccacctagcgtctgtccaa

SEQ ID NO: 1407702 - DNA, 22 bp, Artificial Sequence
  chemically synthesized
gtcccactgatgaatggattgg

SEQ ID NO: 1407703 - DNA, 22 bp, Artificial Sequence
  chemically synthesized
ggtcccactgatgaatggattg

SEQ ID NO: 1407704 - DNA, 22 bp, Artificial Sequence
  chemically synthesized
gcgtctgtccaatccattcatc

SEQ ID NO: 1407705 - DNA, 22 bp, Artificial Sequence
  chemically synthesized
tatttggtcccactgatgaatg

SEQ ID NO: 1407706 - DNA, 22 bp, Artificial Sequence
  chemically synthesized
tgtatttggtcccactgatgaa

SEQ ID NO: 1407707 - DNA, 22 bp, Artificial Sequence
  chemically synthesized
tccaatccattcatcagtggga

SEQ ID NO: 1407708 - DNA, 22 bp, Artificial Sequence
  chemically synthesized
gaaagtgctctgtatttggtcc

SEQ ID NO: 1407709 - DNA, 22 bp, Artificial Sequence
  chemically synthesized
atcagtgggaccaaatacagag

SEQ ID NO: 1407710 - DNA, 22 bp, Artificial Sequence
  chemically synthesized
cggttagaaagtgctctgtatt

SEQ ID NO: 1407711 - DNA, 22 bp, Artificial Sequence
  chemically synthesized
gcggttagaaagtgctctgtat

SEQ ID NO: 1407712 - DNA, 22 bp, Artificial Sequence
  chemically synthesized
atttgcggttagaaagtgctct

SEQ ID NO: 1407713 - DNA, 22 bp, Artificial Sequence
  chemically synthesized
catttgcggttagaaagtgctc

SEQ ID NO: 1407714 - DNA, 22 bp, Artificial Sequence
  chemically synthesized
cttcatttgcggttagaaagtg

SEQ ID NO: 1407715 - DNA, 22 bp, Artificial Sequence
  chemically synthesized
gcttcatttgcggttagaaagt

SEQ ID NO: 1407716 - DNA, 22 bp, Artificial Sequence
  chemically synthesized
ggcttgcttcatttgcggttag

SEQ ID NO: 1407717 - DNA, 22 bp, Artificial Sequence
  chemically synthesized
aggcttgcttcatttgcggtta

SEQ ID NO: 1407718 - DNA, 22 bp, Artificial Sequence
  chemically synthesized
tagtttaggcttgcttcatttg

SEQ ID NO: 1407719 - DNA, 22 bp, Artificial Sequence
  chemically synthesized
atagtttaggcttgcttcattt

SEQ ID NO: 1407720 - DNA, 22 bp, Artificial Sequence
  chemically synthesized
tctaaccgcaaatgaagcaagc

SEQ ID NO: 1407721 - DNA, 22 bp, Artificial Sequence
  chemically synthesized
ctaaccgcaaatgaagcaagcc

SEQ ID NO: 1407722 - DNA, 22 bp, Artificial Sequence
  chemically synthesized
gtttatagtttaggcttgcttc

SEQ ID NO: 1407723 - DNA, 22 bp, Artificial Sequence
  chemically synthesized
taaccgcaaatgaagcaagcct

SEQ ID NO: 1407724 - DNA, 22 bp, Artificial Sequence
  chemically synthesized
agtttatagtttaggcttgctt

SEQ ID NO: 1407725 - DNA, 22 bp, Artificial Sequence
  chemically synthesized
tagtttatagtttaggcttgct

SEQ ID NO: 1407726 - DNA, 22 bp, Artificial Sequence
  chemically synthesized
accgcaaatgaagcaagcctaa

SEQ ID NO: 1407727 - DNA, 22 bp, Artificial Sequence
  chemically synthesized
ttagtttatagtttaggcttgc

SEQ ID NO: 1407728 - DNA, 22 bp, Artificial Sequence
  chemically synthesized
tttagtttatagtttaggcttg

SEQ ID NO: 1407729 - DNA, 22 bp, Artificial Sequence
  chemically synthesized
tattttttagtttatagtttag

SEQ ID NO: 1407730 - DNA, 22 bp, Artificial Sequence
  chemically synthesized
gtattttttagtttatagttta

SEQ ID NO: 1407731 - DNA, 22 bp, Artificial Sequence
  chemically synthesized
tgtattttttagtttatagttt

SEQ ID NO: 1407732 - DNA, 22 bp, Artificial Sequence
  chemically synthesized
ttgtattttttagtttatagtt

SEQ ID NO: 1407733 - DNA, 22 bp, Artificial Sequence
  chemically synthesized
tgtttttgtattttttagttta

SEQ ID NO: 1407734 - DNA, 22 bp, Artificial Sequence
  chemically synthesized
aactataaactaaaaaatacaa

SEQ ID NO: 1407735 - DNA, 22 bp, Artificial Sequence
  chemically synthesized
taaactaaaaaatacaaaaaca

SEQ ID NO: 1407736 - DNA, 22 bp, Artificial Sequence
  chemically synthesized
gaatccccaaactgtgtttttg

SEQ ID NO: 1407737 - DNA, 22 bp, Artificial Sequence
  chemically synthesized
aaaaatacaaaaacacagtttg

SEQ ID NO: 1407738 - DNA, 22 bp, Artificial Sequence
  chemically synthesized
aatcagccactggaatccccaa

SEQ ID NO: 1407739 - DNA, 22 bp, Artificial Sequence
  chemically synthesized
aaatcagccactggaatcccca

SEQ ID NO: 1407740 - DNA, 22 bp, Artificial Sequence
  chemically synthesized
taaatcagccactggaatcccc

SEQ ID NO: 1407741 - DNA, 22 bp, Artificial Sequence
  chemically synthesized
ggggattccagtggctgattta

SEQ ID NO: 1407742 - DNA, 22 bp, Artificial Sequence
  chemically synthesized
gggattccagtggctgatttaa

SEQ ID NO: 1407743 - DNA, 22 bp, Artificial Sequence
  chemically synthesized
aatgaagatagcgtactttaaa

SEQ ID NO: 1407744 - DNA, 22 bp, Artificial Sequence
  chemically synthesized
caatgaagatagcgtactttaa

SEQ ID NO: 1407745 - DNA, 22 bp, Artificial Sequence
  chemically synthesized
cagtggctgatttaaagtacgc

SEQ ID NO: 1407746 - DNA, 22 bp, Artificial Sequence
  chemically synthesized
tcaatgaagatagcgtacttta

SEQ ID NO: 1407747 - DNA, 22 bp, Artificial Sequence
  chemically synthesized
ttcaatgaagatagcgtacttt

SEQ ID NO: 1407748 - DNA, 22 bp, Artificial Sequence
  chemically synthesized
tttcaatgaagatagcgtactt

SEQ ID NO: 1407749 - DNA, 22 bp, Artificial Sequence
  chemically synthesized
tttttcaatgaagatagcgtac

SEQ ID NO: 1407750 - DNA, 22 bp, Artificial Sequence
  chemically synthesized
ctttttcaatgaagatagcgta

SEQ ID NO: 1407751 - DNA, 22 bp, Artificial Sequence
  chemically synthesized
tctttttcaatgaagatagcgt

SEQ ID NO: 1407752 - DNA, 22 bp, Artificial Sequence
  chemically synthesized
ttctttttcaatgaagatagcg

SEQ ID NO: 1407753 - DNA, 22 bp, Artificial Sequence
  chemically synthesized
atttaaagtacgctatcttcat

SEQ ID NO: 1407754 - DNA, 22 bp, Artificial Sequence
  chemically synthesized
aaagtacgctatcttcattgaa

SEQ ID NO: 1407755 - DNA, 22 bp, Artificial Sequence
  chemically synthesized
aagtacgctatcttcattgaaa

SEQ ID NO: 1407756 - DNA, 22 bp, Artificial Sequence
  chemically synthesized
aaagaaggtttttctttttcaa

SEQ ID NO: 1407757 - DNA, 22 bp, Artificial Sequence
  chemically synthesized
aaaagaaggtttttctttttca

SEQ ID NO: 1407758 - DNA, 22 bp, Artificial Sequence
  chemically synthesized
taaaagaaggtttttctttttc

SEQ ID NO: 1407759 - DNA, 22 bp, Artificial Sequence
  chemically synthesized
ttaaaagaaggtttttcttttt

SEQ ID NO: 1407760 - DNA, 22 bp, Artificial Sequence
  chemically synthesized
tcttcattgaaaaagaaaaacc

SEQ ID NO: 1407761 - DNA, 22 bp, Artificial Sequence
  chemically synthesized
cttttaaaagaaggtttttctt

SEQ ID NO: 1407762 - DNA, 22 bp, Artificial Sequence
  chemically synthesized
cattgaaaaagaaaaaccttct

SEQ ID NO: 1407763 - DNA, 22 bp, Artificial Sequence
  chemically synthesized
attgaaaaagaaaaaccttctt

SEQ ID NO: 1407764 - DNA, 22 bp, Artificial Sequence
  chemically synthesized
aaaaagaaaaaccttcttttaa

SEQ ID NO: 1407765 - DNA, 22 bp, Artificial Sequence
  chemically synthesized
ccatagttacttttaaaagaag

SEQ ID NO: 1407766 - DNA, 22 bp, Artificial Sequence
  chemically synthesized
ttaccatagttacttttaaaag

SEQ ID NO: 1407767 - DNA, 22 bp, Artificial Sequence
  chemically synthesized
gttaccatagttacttttaaaa

SEQ ID NO: 1407768 - DNA, 22 bp, Artificial Sequence
  chemically synthesized
ttgttaccatagttacttttaa

SEQ ID NO: 1407769 - DNA, 22 bp, Artificial Sequence
  chemically synthesized
tcttgttaccatagttactttt

SEQ ID NO: 1407770 - DNA, 22 bp, Artificial Sequence
  chemically synthesized
actctcttgttaccatagttac

SEQ ID NO: 1407771 - DNA, 22 bp, Artificial Sequence
  chemically synthesized
cttttaaaagtaactatggtaa

SEQ ID NO: 1407772 - DNA, 22 bp, Artificial Sequence
  chemically synthesized
ttttaaaagtaactatggtaac

SEQ ID NO: 1407773 - DNA, 22 bp, Artificial Sequence
  chemically synthesized
gcctcactctcttgttaccata

SEQ ID NO: 1407774 - DNA, 22 bp, Artificial Sequence
  chemically synthesized
ttaaaagtaactatggtaacaa

SEQ ID NO: 1407775 - DNA, 22 bp, Artificial Sequence
  chemically synthesized
taaaagtaactatggtaacaag

SEQ ID NO: 1407776 - DNA, 22 bp, Artificial Sequence
  chemically synthesized
tagcctcactctcttgttacca

SEQ ID NO: 1407777 - DNA, 22 bp, Artificial Sequence
  chemically synthesized
aaaagtaactatggtaacaaga

SEQ ID NO: 1407778 - DNA, 22 bp, Artificial Sequence
  chemically synthesized
ctagcctcactctcttgttacc

SEQ ID NO: 1407779 - DNA, 22 bp, Artificial Sequence
  chemically synthesized
aaagtaactatggtaacaagag

SEQ ID NO: 1407780 - DNA, 22 bp, Artificial Sequence
  chemically synthesized
cttctagcctcactctcttgtt

SEQ ID NO: 1407781 - DNA, 22 bp, Artificial Sequence
  chemically synthesized
ccttctagcctcactctcttgt

SEQ ID NO: 1407782 - DNA, 22 bp, Artificial Sequence
  chemically synthesized
tggtaacaagagagtgaggcta

SEQ ID NO: 1407783 - DNA, 22 bp, Artificial Sequence
  chemically synthesized
gaaaaaatgtgagcttccttct

SEQ ID NO: 1407784 - DNA, 22 bp, Artificial Sequence
  chemically synthesized
cgaaaaaatgtgagcttccttc

SEQ ID NO: 1407785 - DNA, 22 bp, Artificial Sequence
  chemically synthesized
cttcgaaaaaatgtgagcttcc

SEQ ID NO: 1407786 - DNA, 22 bp, Artificial Sequence
  chemically synthesized
tctccttcgaaaaaatgtgagc

SEQ ID NO: 1407787 - DNA, 22 bp, Artificial Sequence
  chemically synthesized
gaaggaagctcacattttttcg

SEQ ID NO: 1407788 - DNA, 22 bp, Artificial Sequence
  chemically synthesized
tgaattgtctccttcgaaaaaa

SEQ ID NO: 1407789 - DNA, 22 bp, Artificial Sequence
  chemically synthesized
gtgaattgtctccttcgaaaaa

SEQ ID NO: 1407790 - DNA, 22 bp, Artificial Sequence
  chemically synthesized
tgtgaattgtctccttcgaaaa

SEQ ID NO: 1407791 - DNA, 22 bp, Artificial Sequence
  chemically synthesized
ttgtgaattgtctccttcgaaa

SEQ ID NO: 1407792 - DNA, 22 bp, Artificial Sequence
  chemically synthesized
cttttgtgaattgtctccttcg

SEQ ID NO: 1407793 - DNA, 22 bp, Artificial Sequence
  chemically synthesized
tccttttgtgaattgtctcctt

SEQ ID NO: 1407794 - DNA, 22 bp, Artificial Sequence
  chemically synthesized
acattttttcgaaggagacaat

SEQ ID NO: 1407795 - DNA, 22 bp, Artificial Sequence
  chemically synthesized
tttcgaaggagacaattcacaa

SEQ ID NO: 1407796 - DNA, 22 bp, Artificial Sequence
  chemically synthesized
ttcgaaggagacaattcacaaa

SEQ ID NO: 1407797 - DNA, 22 bp, Artificial Sequence
  chemically synthesized
tcgaaggagacaattcacaaaa

SEQ ID NO: 1407798 - DNA, 22 bp, Artificial Sequence
  chemically synthesized
gtaggactctccttttgtgaat

SEQ ID NO: 1407799 - DNA, 22 bp, Artificial Sequence
  chemically synthesized
cgaaggagacaattcacaaaag

SEQ ID NO: 1407800 - DNA, 22 bp, Artificial Sequence
  chemically synthesized
agtaggactctccttttgtgaa

SEQ ID NO: 1407801 - DNA, 22 bp, Artificial Sequence
  chemically synthesized
gaaggagacaattcacaaaagg

SEQ ID NO: 1407802 - DNA, 22 bp, Artificial Sequence
  chemically synthesized
tagtaggactctccttttgtga

SEQ ID NO: 1407803 - DNA, 22 bp, Artificial Sequence
  chemically synthesized
catctttagtaggactctcctt

SEQ ID NO: 1407804 - DNA, 22 bp, Artificial Sequence
  chemically synthesized
cactgcatctttagtaggactc

SEQ ID NO: 1407805 - DNA, 22 bp, Artificial Sequence
  chemically synthesized
acactgcatctttagtaggact

SEQ ID NO: 1407806 - DNA, 22 bp, Artificial Sequence
  chemically synthesized
tacactgcatctttagtaggac

SEQ ID NO: 1407807 - DNA, 22 bp, Artificial Sequence
  chemically synthesized
acaaaaggagagtcctactaaa

SEQ ID NO: 1407808 - DNA, 22 bp, Artificial Sequence
  chemically synthesized
ttacactgcatctttagtagga

SEQ ID NO: 1407809 - DNA, 22 bp, Artificial Sequence
  chemically synthesized
ttttacactgcatctttagtag

SEQ ID NO: 1407810 - DNA, 22 bp, Artificial Sequence
  chemically synthesized
taaaaactcttttacactgcat

SEQ ID NO: 1407811 - DNA, 22 bp, Artificial Sequence
  chemically synthesized
ctaaagatgcagtgtaaaagag

SEQ ID NO: 1407812 - DNA, 22 bp, Artificial Sequence
  chemically synthesized
aagactgtaaaaactcttttac

SEQ ID NO: 1407813 - DNA, 22 bp, Artificial Sequence
  chemically synthesized
aagatgcagtgtaaaagagttt

SEQ ID NO: 1407814 - DNA, 22 bp, Artificial Sequence
  chemically synthesized
agtgaccattcaagactgtaaa

SEQ ID NO: 1407815 - DNA, 22 bp, Artificial Sequence
  chemically synthesized
aagtgaccattcaagactgtaa

SEQ ID NO: 1407816 - DNA, 22 bp, Artificial Sequence
  chemically synthesized
taagtgaccattcaagactgta

SEQ ID NO: 1407817 - DNA, 22 bp, Artificial Sequence
  chemically synthesized
taaccgttttaagtgaccattc

SEQ ID NO: 1407818 - DNA, 22 bp, Artificial Sequence
  chemically synthesized
ataaccgttttaagtgaccatt

SEQ ID NO: 1407819 - DNA, 22 bp, Artificial Sequence
  chemically synthesized
ttacagtcttgaatggtcactt

SEQ ID NO: 1407820 - DNA, 22 bp, Artificial Sequence
  chemically synthesized
tataaccgttttaagtgaccat

SEQ ID NO: 1407821 - DNA, 22 bp, Artificial Sequence
  chemically synthesized
tacagtcttgaatggtcactta

SEQ ID NO: 1407822 - DNA, 22 bp, Artificial Sequence
  chemically synthesized
ttataaccgttttaagtgacca

SEQ ID NO: 1407823 - DNA, 22 bp, Artificial Sequence
  chemically synthesized
acagtcttgaatggtcacttaa

SEQ ID NO: 1407824 - DNA, 22 bp, Artificial Sequence
  chemically synthesized
tttataaccgttttaagtgacc

SEQ ID NO: 1407825 - DNA, 22 bp, Artificial Sequence
  chemically synthesized
cagtcttgaatggtcacttaaa

SEQ ID NO: 1407826 - DNA, 22 bp, Artificial Sequence
  chemically synthesized
aactttttataaccgttttaag

SEQ ID NO: 1407827 - DNA, 22 bp, Artificial Sequence
  chemically synthesized
caactttttataaccgttttaa

SEQ ID NO: 1407828 - DNA, 22 bp, Artificial Sequence
  chemically synthesized
tcaactttttataaccgtttta

SEQ ID NO: 1407829 - DNA, 22 bp, Artificial Sequence
  chemically synthesized
gaatggtcacttaaaacggtta

SEQ ID NO: 1407830 - DNA, 22 bp, Artificial Sequence
  chemically synthesized
ttcaactttttataaccgtttt

SEQ ID NO: 1407831 - DNA, 22 bp, Artificial Sequence
  chemically synthesized
aatggtcacttaaaacggttat

SEQ ID NO: 1407832 - DNA, 22 bp, Artificial Sequence
  chemically synthesized
cttttcaactttttataaccgt

SEQ ID NO: 1407833 - DNA, 22 bp, Artificial Sequence
  chemically synthesized
aaaacggttataaaaagttgaa

SEQ ID NO: 1407834 - DNA, 22 bp, Artificial Sequence
  chemically synthesized
aaacggttataaaaagttgaaa

SEQ ID NO: 1407835 - DNA, 22 bp, Artificial Sequence
  chemically synthesized
gccaatgttacttttcaacttt

SEQ ID NO: 1407836 - DNA, 22 bp, Artificial Sequence
  chemically synthesized
ggccaatgttacttttcaactt

SEQ ID NO: 1407837 - DNA, 22 bp, Artificial Sequence
  chemically synthesized
tggccaatgttacttttcaact

SEQ ID NO: 1407838 - DNA, 22 bp, Artificial Sequence
  chemically synthesized
tttggccaatgttacttttcaa

SEQ ID NO: 1407839 - DNA, 22 bp, Artificial Sequence
  chemically synthesized
taaaaagttgaaaagtaacatt

SEQ ID NO: 1407840 - DNA, 22 bp, Artificial Sequence
  chemically synthesized
aaatacagccctctttggccaa

SEQ ID NO: 1407841 - DNA, 22 bp, Artificial Sequence
  chemically synthesized
aaaatacagccctctttggcca

SEQ ID NO: 1407842 - DNA, 22 bp, Artificial Sequence
  chemically synthesized
aaaagtaacattggccaaagag

SEQ ID NO: 1407843 - DNA, 22 bp, Artificial Sequence
  chemically synthesized
tttaaaatacagccctctttgg

SEQ ID NO: 1407844 - DNA, 22 bp, Artificial Sequence
  chemically synthesized
ttgtttaaaatacagccctctt

SEQ ID NO: 1407845 - DNA, 22 bp, Artificial Sequence
  chemically synthesized
tactgttgtttaaaatacagcc

SEQ ID NO: 1407846 - DNA, 22 bp, Artificial Sequence
  chemically synthesized
gccaaagagggctgtattttaa

SEQ ID NO: 1407847 - DNA, 22 bp, Artificial Sequence
  chemically synthesized
tctatactgttgtttaaaatac

SEQ ID NO: 1407848 - DNA, 22 bp, Artificial Sequence
  chemically synthesized
tgtctatactgttgtttaaaat

SEQ ID NO: 1407849 - DNA, 22 bp, Artificial Sequence
  chemically synthesized
agctctgtctatactgttgttt

SEQ ID NO: 1407850 - DNA, 22 bp, Artificial Sequence
  chemically synthesized
tattttaaacaacagtatagac

SEQ ID NO: 1407851 - DNA, 22 bp, Artificial Sequence
  chemically synthesized
agaaaattcagctctgtctata

SEQ ID NO: 1407852 - DNA, 22 bp, Artificial Sequence
  chemically synthesized
taaacaacagtatagacagagc

SEQ ID NO: 1407853 - DNA, 22 bp, Artificial Sequence
  chemically synthesized
aaacaacagtatagacagagct

SEQ ID NO: 1407854 - DNA, 22 bp, Artificial Sequence
  chemically synthesized
aacaacagtatagacagagctg

SEQ ID NO: 1407855 - DNA, 22 bp, Artificial Sequence
  chemically synthesized
gttgagaaaattcagctctgtc

SEQ ID NO: 1407856 - DNA, 22 bp, Artificial Sequence
  chemically synthesized
tggttggttgagaaaattcagc

SEQ ID NO: 1407857 - DNA, 22 bp, Artificial Sequence
  chemically synthesized
gtggttggttgagaaaattcag

SEQ ID NO: 1407858 - DNA, 22 bp, Artificial Sequence
  chemically synthesized
tgtggttggttgagaaaattca

SEQ ID NO: 1407859 - DNA, 22 bp, Artificial Sequence
  chemically synthesized
ttttgtggttggttgagaaaat

SEQ ID NO: 1407860 - DNA, 22 bp, Artificial Sequence
  chemically synthesized
cagggttattttgtggttggtt

SEQ ID NO: 1407861 - DNA, 22 bp, Artificial Sequence
  chemically synthesized
aattttctcaaccaaccacaaa

SEQ ID NO: 1407862 - DNA, 22 bp, Artificial Sequence
  chemically synthesized
tctcaaccaaccacaaaataac

SEQ ID NO: 1407863 - DNA, 22 bp, Artificial Sequence
  chemically synthesized
ctcaaccaaccacaaaataacc

SEQ ID NO: 1407864 - DNA, 22 bp, Artificial Sequence
  chemically synthesized
tcaaccaaccacaaaataaccc

SEQ ID NO: 1407865 - DNA, 22 bp, Artificial Sequence
  chemically synthesized
aaccaaccacaaaataaccctg

SEQ ID NO: 1407866 - DNA, 22 bp, Artificial Sequence
  chemically synthesized
catccaaatgctacagggttat

SEQ ID NO: 1407867 - DNA, 22 bp, Artificial Sequence
  chemically synthesized
gcatccaaatgctacagggtta

SEQ ID NO: 1407868 - DNA, 22 bp, Artificial Sequence
  chemically synthesized
tgcatccaaatgctacagggtt

SEQ ID NO: 1407869 - DNA, 22 bp, Artificial Sequence
  chemically synthesized
acagaattttgcatccaaatgc

SEQ ID NO: 1407870 - DNA, 22 bp, Artificial Sequence
  chemically synthesized
aaagactgacagaattttgcat

SEQ ID NO: 1407871 - DNA, 22 bp, Artificial Sequence
  chemically synthesized
tagcatttggatgcaaaattct

SEQ ID NO: 1407872 - DNA, 22 bp, Artificial Sequence
  chemically synthesized
ggaagctcaaagactgacagaa

SEQ ID NO: 1407873 - DNA, 22 bp, Artificial Sequence
  chemically synthesized
gggaagctcaaagactgacaga

SEQ ID NO: 1407874 - DNA, 22 bp, Artificial Sequence
  chemically synthesized
ggatgcaaaattctgtcagtct

SEQ ID NO: 1407875 - DNA, 22 bp, Artificial Sequence
  chemically synthesized
tgggaagctcaaagactgacag

SEQ ID NO: 1407876 - DNA, 22 bp, Artificial Sequence
  chemically synthesized
gatgcaaaattctgtcagtctt

SEQ ID NO: 1407877 - DNA, 22 bp, Artificial Sequence
  chemically synthesized
atctttgggaagctcaaagact

SEQ ID NO: 1407878 - DNA, 22 bp, Artificial Sequence
  chemically synthesized
gttaatctttgggaagctcaaa

SEQ ID NO: 1407879 - DNA, 22 bp, Artificial Sequence
  chemically synthesized
ggttaatctttgggaagctcaa

SEQ ID NO: 1407880 - DNA, 22 bp, Artificial Sequence
  chemically synthesized
tgtcagtctttgagcttcccaa

SEQ ID NO: 1407881 - DNA, 22 bp, Artificial Sequence
  chemically synthesized
tcagtctttgagcttcccaaag

SEQ ID NO: 1407882 - DNA, 22 bp, Artificial Sequence
  chemically synthesized
cagaacttggttaatctttggg

SEQ ID NO: 1407883 - DNA, 22 bp, Artificial Sequence
  chemically synthesized
tgagcttcccaaagattaacca

SEQ ID NO: 1407884 - DNA, 22 bp, Artificial Sequence
  chemically synthesized
gagcttcccaaagattaaccaa

SEQ ID NO: 1407885 - DNA, 22 bp, Artificial Sequence
  chemically synthesized
agcttcccaaagattaaccaag

SEQ ID NO: 1407886 - DNA, 22 bp, Artificial Sequence
  chemically synthesized
cccaaagattaaccaagttctg

SEQ ID NO: 1407887 - DNA, 22 bp, Artificial Sequence
  chemically synthesized
tatagtgtgttacagaacttgg

SEQ ID NO: 1407888 - DNA, 22 bp, Artificial Sequence
  chemically synthesized
ccaaagattaaccaagttctgt

SEQ ID NO: 1407889 - DNA, 22 bp, Artificial Sequence
  chemically synthesized
gtatagtgtgttacagaacttg

SEQ ID NO: 1407890 - DNA, 22 bp, Artificial Sequence
  chemically synthesized
tgtatagtgtgttacagaactt

SEQ ID NO: 1407891 - DNA, 22 bp, Artificial Sequence
  chemically synthesized
ttgtatagtgtgttacagaact

SEQ ID NO: 1407892 - DNA, 22 bp, Artificial Sequence
  chemically synthesized
accaagttctgtaacacactat

SEQ ID NO: 1407893 - DNA, 22 bp, Artificial Sequence
  chemically synthesized
tagatgcttttgtatagtgtgt

SEQ ID NO: 1407894 - DNA, 22 bp, Artificial Sequence
  chemically synthesized
agtactgtagatgcttttgtat

SEQ ID NO: 1407895 - DNA, 22 bp, Artificial Sequence
  chemically synthesized
tgtaacacactatacaaaagca

SEQ ID NO: 1407896 - DNA, 22 bp, Artificial Sequence
  chemically synthesized
aagtactgtagatgcttttgta

SEQ ID NO: 1407897 - DNA, 22 bp, Artificial Sequence
  chemically synthesized
taagtactgtagatgcttttgt

SEQ ID NO: 1407898 - DNA, 22 bp, Artificial Sequence
  chemically synthesized
taacacactatacaaaagcatc

SEQ ID NO: 1407899 - DNA, 22 bp, Artificial Sequence
  chemically synthesized
ttaagtactgtagatgcttttg

SEQ ID NO: 1407900 - DNA, 22 bp, Artificial Sequence
  chemically synthesized
atacttttaagtactgtagatg

SEQ ID NO: 1407901 - DNA, 22 bp, Artificial Sequence
  chemically synthesized
aatacttttaagtactgtagat

SEQ ID NO: 1407902 - DNA, 22 bp, Artificial Sequence
  chemically synthesized
tacaaaagcatctacagtactt

SEQ ID NO: 1407903 - DNA, 22 bp, Artificial Sequence
  chemically synthesized
cgtttaatacttttaagtactg

SEQ ID NO: 1407904 - DNA, 22 bp, Artificial Sequence
  chemically synthesized
ccgtttaatacttttaagtact

SEQ ID NO: 1407905 - DNA, 22 bp, Artificial Sequence
  chemically synthesized
tttccgtttaatacttttaagt

SEQ ID NO: 1407906 - DNA, 22 bp, Artificial Sequence
  chemically synthesized
attatttccgtttaatactttt

SEQ ID NO: 1407907 - DNA, 22 bp, Artificial Sequence
  chemically synthesized
tgattatttccgtttaatactt

SEQ ID NO: 1407908 - DNA, 22 bp, Artificial Sequence
  chemically synthesized
cagtacttaaaagtattaaacg

SEQ ID NO: 1407909 - DNA, 22 bp, Artificial Sequence
  chemically synthesized
aggcactctgattatttccgtt

SEQ ID NO: 1407910 - DNA, 22 bp, Artificial Sequence
  chemically synthesized
aaaagtattaaacggaaataat

SEQ ID NO: 1407911 - DNA, 22 bp, Artificial Sequence
  chemically synthesized
aaagtattaaacggaaataatc

SEQ ID NO: 1407912 - DNA, 22 bp, Artificial Sequence
  chemically synthesized
taatgtggttcaggcactctga

SEQ ID NO: 1407913 - DNA, 22 bp, Artificial Sequence
  chemically synthesized
aacggaaataatcagagtgcct

SEQ ID NO: 1407914 - DNA, 22 bp, Artificial Sequence
  chemically synthesized
ataatgtggttcaggcactctg

SEQ ID NO: 1407915 - DNA, 22 bp, Artificial Sequence
  chemically synthesized
tataatgtggttcaggcactct

SEQ ID NO: 1407916 - DNA, 22 bp, Artificial Sequence
  chemically synthesized
ttataatgtggttcaggcactc

SEQ ID NO: 1407917 - DNA, 22 bp, Artificial Sequence
  chemically synthesized
tttataatgtggttcaggcact

SEQ ID NO: 1407918 - DNA, 22 bp, Artificial Sequence
  chemically synthesized
ttttataatgtggttcaggcac

SEQ ID NO: 1407919 - DNA, 22 bp, Artificial Sequence
  chemically synthesized
tttttataatgtggttcaggca

SEQ ID NO: 1407920 - DNA, 22 bp, Artificial Sequence
  chemically synthesized
ttttttataatgtggttcaggc

SEQ ID NO: 1407921 - DNA, 22 bp, Artificial Sequence
  chemically synthesized
gcagcaaagaatttttttttat

SEQ ID NO: 1407922 - DNA, 22 bp, Artificial Sequence
  chemically synthesized
agcagcaaagaattttttttta

SEQ ID NO: 1407923 - DNA, 22 bp, Artificial Sequence
  chemically synthesized
tagcagcaaagaattttttttt

SEQ ID NO: 1407924 - DNA, 22 bp, Artificial Sequence
  chemically synthesized
aaccacattataaaaaaaaatt

SEQ ID NO: 1407925 - DNA, 22 bp, Artificial Sequence
  chemically synthesized
taaaaaaaaattctttgctgct

SEQ ID NO: 1407926 - DNA, 22 bp, Artificial Sequence
  chemically synthesized
gatgtatcattttagcagcaaa

SEQ ID NO: 1407927 - DNA, 22 bp, Artificial Sequence
  chemically synthesized
tagatgtatcattttagcagca

SEQ ID NO: 1407928 - DNA, 22 bp, Artificial Sequence
  chemically synthesized
ctagatgtatcattttagcagc

SEQ ID NO: 1407929 - DNA, 22 bp, Artificial Sequence
  chemically synthesized
tctagatgtatcattttagcag

SEQ ID NO: 1407930 - DNA, 22 bp, Artificial Sequence
  chemically synthesized
tttgctgctaaaatgatacatc

SEQ ID NO: 1407931 - DNA, 22 bp, Artificial Sequence
  chemically synthesized
tgctgctaaaatgatacatcta

SEQ ID NO: 1407932 - DNA, 22 bp, Artificial Sequence
  chemically synthesized
gctgctaaaatgatacatctag

SEQ ID NO: 1407933 - DNA, 22 bp, Artificial Sequence
  chemically synthesized
ctgctaaaatgatacatctaga

SEQ ID NO: 1407934 - DNA, 22 bp, Artificial Sequence
  chemically synthesized
ctaaaatgatacatctagaaaa

SEQ ID NO: 1407935 - DNA, 22 bp, Artificial Sequence
  chemically synthesized
aaatgatacatctagaaaacta

SEQ ID NO: 1407936 - DNA, 22 bp, Artificial Sequence
  chemically synthesized
atatatacagcaggaaagaaaa

SEQ ID NO: 1407937 - DNA, 22 bp, Artificial Sequence
  chemically synthesized
gaaaactattttctttcctgct

SEQ ID NO: 1407938 - DNA, 22 bp, Artificial Sequence
  chemically synthesized
ataattcatatatacagcagga

SEQ ID NO: 1407939 - DNA, 22 bp, Artificial Sequence
  chemically synthesized
ttttctttcctgctgtatatat

SEQ ID NO: 1407940 - DNA, 22 bp, Artificial Sequence
  chemically synthesized
tctttcctgctgtatatatgaa

SEQ ID NO: 1407941 - DNA, 22 bp, Artificial Sequence
  chemically synthesized
ctttcctgctgtatatatgaat

SEQ ID NO: 1407942 - DNA, 22 bp, Artificial Sequence
  chemically synthesized
tttcctgctgtatatatgaatt

SEQ ID NO: 1407943 - DNA, 22 bp, Artificial Sequence
  chemically synthesized
aatatcattcataattcatata

SEQ ID NO: 1407944 - DNA, 22 bp, Artificial Sequence
  chemically synthesized
tcctgctgtatatatgaattat

SEQ ID NO: 1407945 - DNA, 22 bp, Artificial Sequence
  chemically synthesized
cctgctgtatatatgaattatg

SEQ ID NO: 1407946 - DNA, 22 bp, Artificial Sequence
  chemically synthesized
ctgctgtatatatgaattatga

SEQ ID NO: 1407947 - DNA, 22 bp, Artificial Sequence
  chemically synthesized
ctgtatatatgaattatgaatg

SEQ ID NO: 1407948 - DNA, 22 bp, Artificial Sequence
  chemically synthesized
ccgtggttgaatatcattcata

SEQ ID NO: 1407949 - DNA, 22 bp, Artificial Sequence
  chemically synthesized
tatatatgaattatgaatgata

SEQ ID NO: 1407950 - DNA, 22 bp, Artificial Sequence
  chemically synthesized
aagcatacattaccgtggttga

SEQ ID NO: 1407951 - DNA, 22 bp, Artificial Sequence
  chemically synthesized
gaagcatacattaccgtggttg

SEQ ID NO: 1407952 - DNA, 22 bp, Artificial Sequence
  chemically synthesized
tgaatgatattcaaccacggta

SEQ ID NO: 1407953 - DNA, 22 bp, Artificial Sequence
  chemically synthesized
accttgaagcatacattaccgt

SEQ ID NO: 1407954 - DNA, 22 bp, Artificial Sequence
  chemically synthesized
aaccttgaagcatacattaccg

SEQ ID NO: 1407955 - DNA, 22 bp, Artificial Sequence
  chemically synthesized
taaccttgaagcatacattacc

SEQ ID NO: 1407956 - DNA, 22 bp, Artificial Sequence
  chemically synthesized
ttaaccttgaagcatacattac

SEQ ID NO: 1407957 - DNA, 22 bp, Artificial Sequence
  chemically synthesized
tttaaccttgaagcatacatta

SEQ ID NO: 1407958 - DNA, 22 bp, Artificial Sequence
  chemically synthesized
ctttttaaccttgaagcataca

SEQ ID NO: 1407959 - DNA, 22 bp, Artificial Sequence
  chemically synthesized
aaccacggtaatgtatgcttca

SEQ ID NO: 1407960 - DNA, 22 bp, Artificial Sequence
  chemically synthesized
gatgactactttttaaccttga

SEQ ID NO: 1407961 - DNA, 22 bp, Artificial Sequence
  chemically synthesized
ggatgactactttttaaccttg

SEQ ID NO: 1407962 - DNA, 22 bp, Artificial Sequence
  chemically synthesized
caaggttaaaaagtagtcatcc

SEQ ID NO: 1407963 - DNA, 22 bp, Artificial Sequence
  chemically synthesized
aaggttaaaaagtagtcatcca

SEQ ID NO: 1407964 - DNA, 22 bp, Artificial Sequence
  chemically synthesized
aaaaatagtcaaggatttggat

SEQ ID NO: 1407965 - DNA, 22 bp, Artificial Sequence
  chemically synthesized
gaaaaatagtcaaggatttgga

SEQ ID NO: 1407966 - DNA, 22 bp, Artificial Sequence
  chemically synthesized
aaaagtagtcatccaaatcctt

SEQ ID NO: 1407967 - DNA, 22 bp, Artificial Sequence
  chemically synthesized
tgaaaaatagtcaaggatttgg

SEQ ID NO: 1407968 - DNA, 22 bp, Artificial Sequence
  chemically synthesized
ttttgaaaaatagtcaaggatt

SEQ ID NO: 1407969 - DNA, 22 bp, Artificial Sequence
  chemically synthesized
tgttttgaaaaatagtcaagga

SEQ ID NO: 1407970 - DNA, 22 bp, Artificial Sequence
  chemically synthesized
ctgttttgaaaaatagtcaagg

SEQ ID NO: 1407971 - DNA, 22 bp, Artificial Sequence
  chemically synthesized
acttctgttttgaaaaatagtc

SEQ ID NO: 1407972 - DNA, 22 bp, Artificial Sequence
  chemically synthesized
ctaacttctgttttgaaaaata

SEQ ID NO: 1407973 - DNA, 22 bp, Artificial Sequence
  chemically synthesized
gactatttttcaaaacagaagt

SEQ ID NO: 1407974 - DNA, 22 bp, Artificial Sequence
  chemically synthesized
actatttttcaaaacagaagtt

SEQ ID NO: 1407975 - DNA, 22 bp, Artificial Sequence
  chemically synthesized
caaaataattgctaacttctgt

SEQ ID NO: 1407976 - DNA, 22 bp, Artificial Sequence
  chemically synthesized
tccaaaataattgctaacttct

SEQ ID NO: 1407977 - DNA, 22 bp, Artificial Sequence
  chemically synthesized
tttttcaaaacagaagttagca

SEQ ID NO: 1407978 - DNA, 22 bp, Artificial Sequence
  chemically synthesized
ctccaaaataattgctaacttc

SEQ ID NO: 1407979 - DNA, 22 bp, Artificial Sequence
  chemically synthesized
ttcaaaacagaagttagcaatt

SEQ ID NO: 1407980 - DNA, 22 bp, Artificial Sequence
  chemically synthesized
tcaaaacagaagttagcaatta

SEQ ID NO: 1407981 - DNA, 22 bp, Artificial Sequence
  chemically synthesized
caaaacagaagttagcaattat

SEQ ID NO: 1407982 - DNA, 22 bp, Artificial Sequence
  chemically synthesized
aaaacagaagttagcaattatt

SEQ ID NO: 1407983 - DNA, 22 bp, Artificial Sequence
  chemically synthesized
ggatttctccaaaataattgct

SEQ ID NO: 1407984 - DNA, 22 bp, Artificial Sequence
  chemically synthesized
cactaggatttctccaaaataa

SEQ ID NO: 1407985 - DNA, 22 bp, Artificial Sequence
  chemically synthesized
attacactaggatttctccaaa

SEQ ID NO: 1407986 - DNA, 22 bp, Artificial Sequence
  chemically synthesized
gcaattattttggagaaatcct

SEQ ID NO: 1407987 - DNA, 22 bp, Artificial Sequence
  chemically synthesized
ttttggagaaatcctagtgtaa

SEQ ID NO: 1407988 - DNA, 22 bp, Artificial Sequence
  chemically synthesized
tggagaaatcctagtgtaatta

SEQ ID NO: 1407989 - DNA, 22 bp, Artificial Sequence
  chemically synthesized
ggagaaatcctagtgtaattag

SEQ ID NO: 1407990 - DNA, 22 bp, Artificial Sequence
  chemically synthesized
gcaagtggtgggctaattacac

SEQ ID NO: 1407991 - DNA, 22 bp, Artificial Sequence
  chemically synthesized
gagaaatcctagtgtaattagc

SEQ ID NO: 1407992 - DNA, 22 bp, Artificial Sequence
  chemically synthesized
attagcaagtggtgggctaatt

SEQ ID NO: 1407993 - DNA, 22 bp, Artificial Sequence
  chemically synthesized
gtgtaattagcccaccacttgc

SEQ ID NO: 1407994 - DNA, 22 bp, Artificial Sequence
  chemically synthesized
aatatcagtaaattaattagca

SEQ ID NO: 1407995 - DNA, 22 bp, Artificial Sequence
  chemically synthesized
aaatatcagtaaattaattagc

SEQ ID NO: 1407996 - DNA, 22 bp, Artificial Sequence
  chemically synthesized
gcccaccacttgctaattaatt

SEQ ID NO: 1407997 - DNA, 22 bp, Artificial Sequence
  chemically synthesized
gctaattaatttactgatattt

SEQ ID NO: 1407998 - DNA, 22 bp, Artificial Sequence
  chemically synthesized
ctaattaatttactgatattta

SEQ ID NO: 1407999 - DNA, 22 bp, Artificial Sequence
  chemically synthesized
attaatttactgatatttaaat

SEQ ID NO: 1408000 - DNA, 22 bp, Artificial Sequence
  chemically synthesized
aaaacaacatgtatttaaatat

SEQ ID NO: 1408001 - DNA, 22 bp, Artificial Sequence
  chemically synthesized
atttactgatatttaaatacat

SEQ ID NO: 1408002 - DNA, 22 bp, Artificial Sequence
  chemically synthesized
actgatatttaaatacatgttg

SEQ ID NO: 1408003 - DNA, 22 bp, Artificial Sequence
  chemically synthesized
ctgatatttaaatacatgttgt

SEQ ID NO: 1408004 - DNA, 22 bp, Artificial Sequence
  chemically synthesized
atatttaaatacatgttgtttt

SEQ ID NO: 1408005 - DNA, 22 bp, Artificial Sequence
  chemically synthesized
gaaagggtgagttaaaaacaac

SEQ ID NO: 1408006 - DNA, 22 bp, Artificial Sequence
  chemically synthesized
agaaagggtgagttaaaaacaa

SEQ ID NO: 1408007 - DNA, 22 bp, Artificial Sequence
  chemically synthesized
ttagaaagggtgagttaaaaac

SEQ ID NO: 1408008 - DNA, 22 bp, Artificial Sequence
  chemically synthesized
aaatacatgttgtttttaactc

SEQ ID NO: 1408009 - DNA, 22 bp, Artificial Sequence
  chemically synthesized
aatacatgttgtttttaactca

SEQ ID NO: 1408010 - DNA, 22 bp, Artificial Sequence
  chemically synthesized
ctcttagaaagggtgagttaaa

SEQ ID NO: 1408011 - DNA, 22 bp, Artificial Sequence
  chemically synthesized
cgtattcctcttagaaagggtg

SEQ ID NO: 1408012 - DNA, 22 bp, Artificial Sequence
  chemically synthesized
tttttaactcaccctttctaag

SEQ ID NO: 1408013 - DNA, 22 bp, Artificial Sequence
  chemically synthesized
aattacgtattcctcttagaaa

SEQ ID NO: 1408014 - DNA, 22 bp, Artificial Sequence
  chemically synthesized
ttaactcaccctttctaagagg

SEQ ID NO: 1408015 - DNA, 22 bp, Artificial Sequence
  chemically synthesized
caattacgtattcctcttagaa

SEQ ID NO: 1408016 - DNA, 22 bp, Artificial Sequence
  chemically synthesized
taactcaccctttctaagagga

SEQ ID NO: 1408017 - DNA, 22 bp, Artificial Sequence
  chemically synthesized
tcaattacgtattcctcttaga

SEQ ID NO: 1408018 - DNA, 22 bp, Artificial Sequence
  chemically synthesized
aactcaccctttctaagaggaa

SEQ ID NO: 1408019 - DNA, 22 bp, Artificial Sequence
  chemically synthesized
actcaccctttctaagaggaat

SEQ ID NO: 1408020 - DNA, 22 bp, Artificial Sequence
  chemically synthesized
accctttctaagaggaatacgt

SEQ ID NO: 1408021 - DNA, 22 bp, Artificial Sequence
  chemically synthesized
gtccatggttttcaattacgta

SEQ ID NO: 1408022 - DNA, 22 bp, Artificial Sequence
  chemically synthesized
tctaagaggaatacgtaattga

SEQ ID NO: 1408023 - DNA, 22 bp, Artificial Sequence
  chemically synthesized
ctaagaggaatacgtaattgaa

SEQ ID NO: 1408024 - DNA, 22 bp, Artificial Sequence
  chemically synthesized
taagaggaatacgtaattgaaa

SEQ ID NO: 1408025 - DNA, 22 bp, Artificial Sequence
  chemically synthesized
agaggaatacgtaattgaaaac

SEQ ID NO: 1408026 - DNA, 22 bp, Artificial Sequence
  chemically synthesized
aatgttagtccatggttttcaa

SEQ ID NO: 1408027 - DNA, 22 bp, Artificial Sequence
  chemically synthesized
tgaatgttagtccatggttttc

SEQ ID NO: 1408028 - DNA, 22 bp, Artificial Sequence
  chemically synthesized
ctgaatgttagtccatggtttt

SEQ ID NO: 1408029 - DNA, 22 bp, Artificial Sequence
  chemically synthesized
tctgaatgttagtccatggttt

SEQ ID NO: 1408030 - DNA, 22 bp, Artificial Sequence
  chemically synthesized
ttctgaatgttagtccatggtt

SEQ ID NO: 1408031 - DNA, 22 bp, Artificial Sequence
  chemically synthesized
tttctgaatgttagtccatggt

SEQ ID NO: 1408032 - DNA, 22 bp, Artificial Sequence
  chemically synthesized
ttttctgaatgttagtccatgg

SEQ ID NO: 1408033 - DNA, 22 bp, Artificial Sequence
  chemically synthesized
tttttctgaatgttagtccatg

SEQ ID NO: 1408034 - DNA, 22 bp, Artificial Sequence
  chemically synthesized
aaaaccatggactaacattcag

SEQ ID NO: 1408035 - DNA, 22 bp, Artificial Sequence
  chemically synthesized
tgtaactttttttctgaatgtt

SEQ ID NO: 1408036 - DNA, 22 bp, Artificial Sequence
  chemically synthesized
ttatgtaactttttttctgaat

SEQ ID NO: 1408037 - DNA, 22 bp, Artificial Sequence
  chemically synthesized
gctgttatgtaactttttttct

SEQ ID NO: 1408038 - DNA, 22 bp, Artificial Sequence
  chemically synthesized
ttggctgttatgtaactttttt

SEQ ID NO: 1408039 - DNA, 22 bp, Artificial Sequence
  chemically synthesized
acattcagaaaaaaagttacat

SEQ ID NO: 1408040 - DNA, 22 bp, Artificial Sequence
  chemically synthesized
agaaaaaaagttacataacagc

SEQ ID NO: 1408041 - DNA, 22 bp, Artificial Sequence
  chemically synthesized
aggaacactattggctgttatg

SEQ ID NO: 1408042 - DNA, 22 bp, Artificial Sequence
  chemically synthesized
gttaaggaacactattggctgt

SEQ ID NO: 1408043 - DNA, 22 bp, Artificial Sequence
  chemically synthesized
cataacagccaatagtgttcct

SEQ ID NO: 1408044 - DNA, 22 bp, Artificial Sequence
  chemically synthesized
taatatcccagtcagtctggtt

SEQ ID NO: 1408045 - DNA, 22 bp, Artificial Sequence
  chemically synthesized
cttaaccagactgactgggata

SEQ ID NO: 1408046 - DNA, 22 bp, Artificial Sequence
  chemically synthesized
tagtaattgtaatatcccagtc

SEQ ID NO: 1408047 - DNA, 22 bp, Artificial Sequence
  chemically synthesized
tgtagtaattgtaatatcccag

SEQ ID NO: 1408048 - DNA, 22 bp, Artificial Sequence
  chemically synthesized
aaccagactgactgggatatta

SEQ ID NO: 1408049 - DNA, 22 bp, Artificial Sequence
  chemically synthesized
ctgtagtaattgtaatatccca

SEQ ID NO: 1408050 - DNA, 22 bp, Artificial Sequence
  chemically synthesized
accagactgactgggatattac

SEQ ID NO: 1408051 - DNA, 22 bp, Artificial Sequence
  chemically synthesized
tctgtagtaattgtaatatccc

SEQ ID NO: 1408052 - DNA, 22 bp, Artificial Sequence
  chemically synthesized
ttctgtagtaattgtaatatcc

SEQ ID NO: 1408053 - DNA, 22 bp, Artificial Sequence
  chemically synthesized
tgccttttctgtagtaattgta

SEQ ID NO: 1408054 - DNA, 22 bp, Artificial Sequence
  chemically synthesized
actgggatattacaattactac

SEQ ID NO: 1408055 - DNA, 22 bp, Artificial Sequence
  chemically synthesized
ggatattacaattactacagaa

SEQ ID NO: 1408056 - DNA, 22 bp, Artificial Sequence
  chemically synthesized
gtatgtgctgtgccttttctgt

SEQ ID NO: 1408057 - DNA, 22 bp, Artificial Sequence
  chemically synthesized
ctcgtatgtgctgtgccttttc

SEQ ID NO: 1408058 - DNA, 22 bp, Artificial Sequence
  chemically synthesized
caattactacagaaaaggcaca

SEQ ID NO: 1408059 - DNA, 22 bp, Artificial Sequence
  chemically synthesized
ctacagaaaaggcacagcacat

SEQ ID NO: 1408060 - DNA, 22 bp, Artificial Sequence
  chemically synthesized
cagaaaaggcacagcacatacg

SEQ ID NO: 1408061 - DNA, 22 bp, Artificial Sequence
  chemically synthesized
agtgtacacagtgctactcgta

SEQ ID NO: 1408062 - DNA, 22 bp, Artificial Sequence
  chemically synthesized
cagtgtacacagtgctactcgt

SEQ ID NO: 1408063 - DNA, 22 bp, Artificial Sequence
  chemically synthesized
tcagtgtacacagtgctactcg

SEQ ID NO: 1408064 - DNA, 22 bp, Artificial Sequence
  chemically synthesized
atatgacctttcagtgtacaca

SEQ ID NO: 1408065 - DNA, 22 bp, Artificial Sequence
  chemically synthesized
tgtacactgaaaggtcatatta

SEQ ID NO: 1408066 - DNA, 22 bp, Artificial Sequence
  chemically synthesized
tcatatatgtacatctaatatg

SEQ ID NO: 1408067 - DNA, 22 bp, Artificial Sequence
  chemically synthesized
aaaggtcatattagatgtacat

SEQ ID NO: 1408068 - DNA, 22 bp, Artificial Sequence
  chemically synthesized
atagactatcatatatgtacat

SEQ ID NO: 1408069 - DNA, 22 bp, Artificial Sequence
  chemically synthesized
gatgtacatatatgatagtcta

SEQ ID NO: 1408070 - DNA, 22 bp, Artificial Sequence
  chemically synthesized
aatcatccaagttaatagacta

SEQ ID NO: 1408071 - DNA, 22 bp, Artificial Sequence
  chemically synthesized
aggagctaaatcatccaagtta

SEQ ID NO: 1408072 - DNA, 22 bp, Artificial Sequence
  chemically synthesized
catagcctgaggagctaaatca

SEQ ID NO: 1408073 - DNA, 22 bp, Artificial Sequence
  chemically synthesized
ttaacttggatgatttagctcc

SEQ ID NO: 1408074 - DNA, 22 bp, Artificial Sequence
  chemically synthesized
ctccatagcctgaggagctaaa

SEQ ID NO: 1408075 - DNA, 22 bp, Artificial Sequence
  chemically synthesized
acttggatgatttagctcctca

SEQ ID NO: 1408076 - DNA, 22 bp, Artificial Sequence
  chemically synthesized
ggatgatttagctcctcaggct

SEQ ID NO: 1408077 - DNA, 22 bp, Artificial Sequence
  chemically synthesized
gatgatttagctcctcaggcta

SEQ ID NO: 1408078 - DNA, 22 bp, Artificial Sequence
  chemically synthesized
cccagtctcctccatagcctga

SEQ ID NO: 1408079 - DNA, 22 bp, Artificial Sequence
  chemically synthesized
tacccagtctcctccatagcct

SEQ ID NO: 1408080 - DNA, 22 bp, Artificial Sequence
  chemically synthesized
tctacccagtctcctccatagc

SEQ ID NO: 1408081 - DNA, 22 bp, Artificial Sequence
  chemically synthesized
agctcctcaggctatggaggag

SEQ ID NO: 1408082 - DNA, 22 bp, Artificial Sequence
  chemically synthesized
gctcctcaggctatggaggaga

SEQ ID NO: 1408083 - DNA, 22 bp, Artificial Sequence
  chemically synthesized
ggctctctacccagtctcctcc

SEQ ID NO: 1408084 - DNA, 22 bp, Artificial Sequence
  chemically synthesized
cggctctctacccagtctcctc

SEQ ID NO: 1408085 - DNA, 22 bp, Artificial Sequence
  chemically synthesized
ctcaggctatggaggagactgg

SEQ ID NO: 1408086 - DNA, 22 bp, Artificial Sequence
  chemically synthesized
tcggctctctacccagtctcct

SEQ ID NO: 1408087 - DNA, 22 bp, Artificial Sequence
  chemically synthesized
aggctatggaggagactgggta

SEQ ID NO: 1408088 - DNA, 22 bp, Artificial Sequence
  chemically synthesized
tggaggagactgggtagagagc

SEQ ID NO: 1408089 - DNA, 22 bp, Artificial Sequence
  chemically synthesized
tgtaatacagaatctttcggct

SEQ ID NO: 1408090 - DNA, 22 bp, Artificial Sequence
  chemically synthesized
tctatgtaatacagaatctttc

SEQ ID NO: 1408091 - DNA, 22 bp, Artificial Sequence
  chemically synthesized
ggtagagagccgaaagattctg

SEQ ID NO: 1408092 - DNA, 22 bp, Artificial Sequence
  chemically synthesized
actgtctatgtaatacagaatc

SEQ ID NO: 1408093 - DNA, 22 bp, Artificial Sequence
  chemically synthesized
ttaactgtctatgtaatacaga

SEQ ID NO: 1408094 - DNA, 22 bp, Artificial Sequence
  chemically synthesized
attattaactgtctatgtaata

SEQ ID NO: 1408095 - DNA, 22 bp, Artificial Sequence
  chemically synthesized
tgtattacatagacagttaata

SEQ ID NO: 1408096 - DNA, 22 bp, Artificial Sequence
  chemically synthesized
tattacatagacagttaataat

SEQ ID NO: 1408097 - DNA, 22 bp, Artificial Sequence
  chemically synthesized
agtgtgaaaagcctgattatta

SEQ ID NO: 1408098 - DNA, 22 bp, Artificial Sequence
  chemically synthesized
catagacagttaataatcaggc

SEQ ID NO: 1408099 - DNA, 22 bp, Artificial Sequence
  chemically synthesized
ctaagtgtgaaaagcctgatta

SEQ ID NO: 1408100 - DNA, 22 bp, Artificial Sequence
  chemically synthesized
cctaagtgtgaaaagcctgatt

SEQ ID NO: 1408101 - DNA, 22 bp, Artificial Sequence
  chemically synthesized
tcctaagtgtgaaaagcctgat

SEQ ID NO: 1408102 - DNA, 22 bp, Artificial Sequence
  chemically synthesized
ataatcaggcttttcacactta

SEQ ID NO: 1408103 - DNA, 22 bp, Artificial Sequence
  chemically synthesized
aataatatagaaatagattttc

SEQ ID NO: 1408104 - DNA, 22 bp, Artificial Sequence
  chemically synthesized
ttcacacttaggaaaatctatt

SEQ ID NO: 1408105 - DNA, 22 bp, Artificial Sequence
  chemically synthesized
tcacacttaggaaaatctattt

SEQ ID NO: 1408106 - DNA, 22 bp, Artificial Sequence
  chemically synthesized
cacacttaggaaaatctatttc

SEQ ID NO: 1408107 - DNA, 22 bp, Artificial Sequence
  chemically synthesized
acacttaggaaaatctatttct

SEQ ID NO: 1408108 - DNA, 22 bp, Artificial Sequence
  chemically synthesized
aggaaaatctatttctatatta

SEQ ID NO: 1408109 - DNA, 22 bp, Artificial Sequence
  chemically synthesized
ggaaaatctatttctatattat

SEQ ID NO: 1408110 - DNA, 22 bp, Artificial Sequence
  chemically synthesized
aaacagatgttaaataatatag

SEQ ID NO: 1408111 - DNA, 22 bp, Artificial Sequence
  chemically synthesized
aaaacagatgttaaataatata

SEQ ID NO: 1408112 - DNA, 22 bp, Artificial Sequence
  chemically synthesized
tttaaaacagatgttaaataat

SEQ ID NO: 1408113 - DNA, 22 bp, Artificial Sequence
  chemically synthesized
tttctatattatttaacatctg

SEQ ID NO: 1408114 - DNA, 22 bp, Artificial Sequence
  chemically synthesized
ctatattatttaacatctgttt

SEQ ID NO: 1408115 - DNA, 22 bp, Artificial Sequence
  chemically synthesized
tatattatttaacatctgtttt

SEQ ID NO: 1408116 - DNA, 22 bp, Artificial Sequence
  chemically synthesized
tattatttaacatctgttttaa

SEQ ID NO: 1408117 - DNA, 22 bp, Artificial Sequence
  chemically synthesized
acaagtgattgtttaaaacaga

SEQ ID NO: 1408118 - DNA, 22 bp, Artificial Sequence
  chemically synthesized
aacaagtgattgtttaaaacag

SEQ ID NO: 1408119 - DNA, 22 bp, Artificial Sequence
  chemically synthesized
tttaacatctgttttaaacaat

SEQ ID NO: 1408120 - DNA, 22 bp, Artificial Sequence
  chemically synthesized
aacatctgttttaaacaatcac

SEQ ID NO: 1408121 - DNA, 22 bp, Artificial Sequence
  chemically synthesized
acatctgttttaaacaatcact

SEQ ID NO: 1408122 - DNA, 22 bp, Artificial Sequence
  chemically synthesized
aaacatttaacaagtgattgtt

SEQ ID NO: 1408123 - DNA, 22 bp, Artificial Sequence
  chemically synthesized
ttttaaacaatcacttgttaaa

SEQ ID NO: 1408124 - DNA, 22 bp, Artificial Sequence
  chemically synthesized
taaacaatcacttgttaaatgt

SEQ ID NO: 1408125 - DNA, 22 bp, Artificial Sequence
  chemically synthesized
aaacaatcacttgttaaatgtt

SEQ ID NO: 1408126 - DNA, 22 bp, Artificial Sequence
  chemically synthesized
aacaatcacttgttaaatgttt

SEQ ID NO: 1408127 - DNA, 22 bp, Artificial Sequence
  chemically synthesized
gttaaatgtttgaatgttttat

SEQ ID NO: 1408128 - DNA, 22 bp, Artificial Sequence
  chemically synthesized
ttaaatgtttgaatgttttatt

SEQ ID NO: 1408129 - DNA, 22 bp, Artificial Sequence
  chemically synthesized
gggtaacaagcaaataaaacat

SEQ ID NO: 1408130 - DNA, 22 bp, Artificial Sequence
  chemically synthesized
aatgtttgaatgttttatttgc

SEQ ID NO: 1408131 - DNA, 22 bp, Artificial Sequence
  chemically synthesized
tcaccactagggtaacaagcaa

SEQ ID NO: 1408132 - DNA, 22 bp, Artificial Sequence
  chemically synthesized
gaatgttttatttgcttgttac

SEQ ID NO: 1408133 - DNA, 22 bp, Artificial Sequence
  chemically synthesized
atcaccactagggtaacaagca

SEQ ID NO: 1408134 - DNA, 22 bp, Artificial Sequence
  chemically synthesized
aatgttttatttgcttgttacc

SEQ ID NO: 1408135 - DNA, 22 bp, Artificial Sequence
  chemically synthesized
tatcaccactagggtaacaagc

SEQ ID NO: 1408136 - DNA, 22 bp, Artificial Sequence
  chemically synthesized
tatttgcttgttaccctagtgg

SEQ ID NO: 1408137 - DNA, 22 bp, Artificial Sequence
  chemically synthesized
atttgcttgttaccctagtggt

SEQ ID NO: 1408138 - DNA, 22 bp, Artificial Sequence
  chemically synthesized
tttgcttgttaccctagtggtg

SEQ ID NO: 1408139 - DNA, 22 bp, Artificial Sequence
  chemically synthesized
aaataatctttatcaccactag

SEQ ID NO: 1408140 - DNA, 22 bp, Artificial Sequence
  chemically synthesized
gcttgttaccctagtggtgata

SEQ ID NO: 1408141 - DNA, 22 bp, Artificial Sequence
  chemically synthesized
cttgttaccctagtggtgataa

SEQ ID NO: 1408142 - DNA, 22 bp, Artificial Sequence
  chemically synthesized
gttaccctagtggtgataaaga

SEQ ID NO: 1408143 - DNA, 22 bp, Artificial Sequence
  chemically synthesized
ttaccctagtggtgataaagat

SEQ ID NO: 1408144 - DNA, 22 bp, Artificial Sequence
  chemically synthesized
aacatattgaaataatctttat

SEQ ID NO: 1408145 - DNA, 22 bp, Artificial Sequence
  chemically synthesized
ccctagtggtgataaagattat

SEQ ID NO: 1408146 - DNA, 22 bp, Artificial Sequence
  chemically synthesized
gtggtgataaagattatttcaa

SEQ ID NO: 1408147 - DNA, 22 bp, Artificial Sequence
  chemically synthesized
taatcagactgaacatattgaa

SEQ ID NO: 1408148 - DNA, 22 bp, Artificial Sequence
  chemically synthesized
tcagtgactgtaatcagactga

SEQ ID NO: 1408149 - DNA, 22 bp, Artificial Sequence
  chemically synthesized
tttcaatatgttcagtctgatt

SEQ ID NO: 1408150 - DNA, 22 bp, Artificial Sequence
  chemically synthesized
caatatgttcagtctgattaca

SEQ ID NO: 1408151 - DNA, 22 bp, Artificial Sequence
  chemically synthesized
aatatgttcagtctgattacag

SEQ ID NO: 1408152 - DNA, 22 bp, Artificial Sequence
  chemically synthesized
tcatggggatctgtcagtgact

SEQ ID NO: 1408153 - DNA, 22 bp, Artificial Sequence
  chemically synthesized
agtctgattacagtcactgaca

SEQ ID NO: 1408154 - DNA, 22 bp, Artificial Sequence
  chemically synthesized
attacagtcactgacagatccc

SEQ ID NO: 1408155 - DNA, 22 bp, Artificial Sequence
  chemically synthesized
acatgctgtcatggggatctgt

SEQ ID NO: 1408156 - DNA, 22 bp, Artificial Sequence
  chemically synthesized
cacatgctgtcatggggatctg

SEQ ID NO: 1408157 - DNA, 22 bp, Artificial Sequence
  chemically synthesized
cagtcactgacagatccccatg

SEQ ID NO: 1408158 - DNA, 22 bp, Artificial Sequence
  chemically synthesized
tcttcacatgctgtcatgggga

SEQ ID NO: 1408159 - DNA, 22 bp, Artificial Sequence
  chemically synthesized
acagatccccatgacagcatgt

SEQ ID NO: 1408160 - DNA, 22 bp, Artificial Sequence
  chemically synthesized
taacctatcttcacatgctgtc

SEQ ID NO: 1408161 - DNA, 22 bp, Artificial Sequence
  chemically synthesized
tataacctatcttcacatgctg

SEQ ID NO: 1408162 - DNA, 22 bp, Artificial Sequence
  chemically synthesized
ctataacctatcttcacatgct

SEQ ID NO: 1408163 - DNA, 22 bp, Artificial Sequence
  chemically synthesized
tgcatcgtttctataacctatc

SEQ ID NO: 1408164 - DNA, 22 bp, Artificial Sequence
  chemically synthesized
tataaactatgcatcgtttcta

SEQ ID NO: 1408165 - DNA, 22 bp, Artificial Sequence
  chemically synthesized
gtataaactatgcatcgtttct

SEQ ID NO: 1408166 - DNA, 22 bp, Artificial Sequence
  chemically synthesized
tgtataaactatgcatcgtttc

SEQ ID NO: 1408167 - DNA, 22 bp, Artificial Sequence
  chemically synthesized
ttgtataaactatgcatcgttt

SEQ ID NO: 1408168 - DNA, 22 bp, Artificial Sequence
  chemically synthesized
tttgtataaactatgcatcgtt

SEQ ID NO: 1408169 - DNA, 22 bp, Artificial Sequence
  chemically synthesized
tgctttttgtataaactatgca

SEQ ID NO: 1408170 - DNA, 22 bp, Artificial Sequence
  chemically synthesized
atgctttttgtataaactatgc

SEQ ID NO: 1408171 - DNA, 22 bp, Artificial Sequence
  chemically synthesized
tagaaacgatgcatagtttata

SEQ ID NO: 1408172 - DNA, 22 bp, Artificial Sequence
  chemically synthesized
gagaaaggggagcaatttatgc

SEQ ID NO: 1408173 - DNA, 22 bp, Artificial Sequence
  chemically synthesized
ggagaaaggggagcaatttatg

SEQ ID NO: 1408174 - DNA, 22 bp, Artificial Sequence
  chemically synthesized
tggagaaaggggagcaatttat

SEQ ID NO: 1408175 - DNA, 22 bp, Artificial Sequence
  chemically synthesized
atacaaaaagcataaattgctc

SEQ ID NO: 1408176 - DNA, 22 bp, Artificial Sequence
  chemically synthesized
ttggagaaaggggagcaattta

SEQ ID NO: 1408177 - DNA, 22 bp, Artificial Sequence
  chemically synthesized
tacaaaaagcataaattgctcc

SEQ ID NO: 1408178 - DNA, 22 bp, Artificial Sequence
  chemically synthesized
caaaaataaagtttttggagaa

SEQ ID NO: 1408179 - DNA, 22 bp, Artificial Sequence
  chemically synthesized
gctccaaaaataaagtttttgg

SEQ ID NO: 1408180 - DNA, 22 bp, Artificial Sequence
  chemically synthesized
ctcccctttctccaaaaacttt

SEQ ID NO: 1408181 - DNA, 22 bp, Artificial Sequence
  chemically synthesized
ggctccaaaaataaagtttttg

SEQ ID NO: 1408182 - DNA, 22 bp, Artificial Sequence
  chemically synthesized
ccctttctccaaaaactttatt

SEQ ID NO: 1408183 - DNA, 22 bp, Artificial Sequence
  chemically synthesized
tctccaaaaactttatttttgg

SEQ ID NO: 1408184 - DNA, 22 bp, Artificial Sequence
  chemically synthesized
ctccaaaaactttatttttgga

SEQ ID NO: 1408185 - DNA, 22 bp, Artificial Sequence
  chemically synthesized
tccaaaaactttatttttggag

SEQ ID NO: 1408186 - DNA, 22 bp, Artificial Sequence
  chemically synthesized
caaaaactttatttttggagcc

SEQ ID NO: 1408187 - DNA, 22 bp, Artificial Sequence
  chemically synthesized
tatttttggagccaaatactgt

SEQ ID NO: 1408188 - DNA, 22 bp, Artificial Sequence
  chemically synthesized
atttttggagccaaatactgtc

SEQ ID NO: 1408189 - DNA, 22 bp, Artificial Sequence
  chemically synthesized
tttttggagccaaatactgtcc

SEQ ID NO: 1408190 - DNA, 22 bp, Artificial Sequence
  chemically synthesized
ttggagccaaatactgtccatg

SEQ ID NO: 1408191 - DNA, 22 bp, Artificial Sequence
  chemically synthesized
tggagccaaatactgtccatgc

SEQ ID NO: 1408192 - DNA, 22 bp, Artificial Sequence
  chemically synthesized
ggagccaaatactgtccatgct

SEQ ID NO: 1408193 - DNA, 22 bp, Artificial Sequence
  chemically synthesized
gagccaaatactgtccatgctc

SEQ ID NO: 1408194 - DNA, 22 bp, Artificial Sequence
  chemically synthesized
agcaaatggagcatgagcatgg

SEQ ID NO: 1408195 - DNA, 22 bp, Artificial Sequence
  chemically synthesized
aagcaaatggagcatgagcatg

SEQ ID NO: 1408196 - DNA, 22 bp, Artificial Sequence
  chemically synthesized
taagcaaatggagcatgagcat

SEQ ID NO: 1408197 - DNA, 22 bp, Artificial Sequence
  chemically synthesized
ttaagcaaatggagcatgagca

SEQ ID NO: 1408198 - DNA, 22 bp, Artificial Sequence
  chemically synthesized
tccatgctcatgctccatttgc

SEQ ID NO: 1408199 - DNA, 22 bp, Artificial Sequence
  chemically synthesized
taagtacttttaagcaaatgga

SEQ ID NO: 1408200 - DNA, 22 bp, Artificial Sequence
  chemically synthesized
taattataagtacttttaagca

SEQ ID NO: 1408201 - DNA, 22 bp, Artificial Sequence
  chemically synthesized
atgctccatttgcttaaaagta

SEQ ID NO: 1408202 - DNA, 22 bp, Artificial Sequence
  chemically synthesized
catttgcttaaaagtacttata

SEQ ID NO: 1408203 - DNA, 22 bp, Artificial Sequence
  chemically synthesized
gcttaaaagtacttataattat

SEQ ID NO: 1408204 - DNA, 22 bp, Artificial Sequence
  chemically synthesized
cttaaaagtacttataattata

SEQ ID NO: 1408205 - DNA, 22 bp, Artificial Sequence
  chemically synthesized
caatcagtggattataattata

SEQ ID NO: 1408206 - DNA, 22 bp, Artificial Sequence
  chemically synthesized
aaaagtacttataattataatc

SEQ ID NO: 1408207 - DNA, 22 bp, Artificial Sequence
  chemically synthesized
aaagtacttataattataatcc

SEQ ID NO: 1408208 - DNA, 22 bp, Artificial Sequence
  chemically synthesized
ccctacaatcagtggattataa

SEQ ID NO: 1408209 - DNA, 22 bp, Artificial Sequence
  chemically synthesized
cccctacaatcagtggattata

SEQ ID NO: 1408210 - DNA, 22 bp, Artificial Sequence
  chemically synthesized
tcccctacaatcagtggattat

SEQ ID NO: 1408211 - DNA, 22 bp, Artificial Sequence
  chemically synthesized
tttcccctacaatcagtggatt

SEQ ID NO: 1408212 - DNA, 22 bp, Artificial Sequence
  chemically synthesized
ctttcccctacaatcagtggat

SEQ ID NO: 1408213 - DNA, 22 bp, Artificial Sequence
  chemically synthesized
ataattataatccactgattgt

SEQ ID NO: 1408214 - DNA, 22 bp, Artificial Sequence
  chemically synthesized
taattataatccactgattgta

SEQ ID NO: 1408215 - DNA, 22 bp, Artificial Sequence
  chemically synthesized
caatatttctttcccctacaat

SEQ ID NO: 1408216 - DNA, 22 bp, Artificial Sequence
  chemically synthesized
gcaatatttctttcccctacaa

SEQ ID NO: 1408217 - DNA, 22 bp, Artificial Sequence
  chemically synthesized
taatccactgattgtaggggaa

SEQ ID NO: 1408218 - DNA, 22 bp, Artificial Sequence
  chemically synthesized
tgcaatatttctttcccctaca

SEQ ID NO: 1408219 - DNA, 22 bp, Artificial Sequence
  chemically synthesized
ttttgcaatatttctttcccct

SEQ ID NO: 1408220 - DNA, 22 bp, Artificial Sequence
  chemically synthesized
tgttttgcaatatttctttccc

SEQ ID NO: 1408221 - DNA, 22 bp, Artificial Sequence
  chemically synthesized
tctgttttgcaatatttctttc

SEQ ID NO: 1408222 - DNA, 22 bp, Artificial Sequence
  chemically synthesized
ctctgttttgcaatatttcttt

SEQ ID NO: 1408223 - DNA, 22 bp, Artificial Sequence
  chemically synthesized
tctctgttttgcaatatttctt

SEQ ID NO: 1408224 - DNA, 22 bp, Artificial Sequence
  chemically synthesized
attgtaggggaaagaaatattg

SEQ ID NO: 1408225 - DNA, 22 bp, Artificial Sequence
  chemically synthesized
taggggaaagaaatattgcaaa

SEQ ID NO: 1408226 - DNA, 22 bp, Artificial Sequence
  chemically synthesized
gaaccctttctctgttttgcaa

SEQ ID NO: 1408227 - DNA, 22 bp, Artificial Sequence
  chemically synthesized
agaaccctttctctgttttgca

SEQ ID NO: 1408228 - DNA, 22 bp, Artificial Sequence
  chemically synthesized
tagaaccctttctctgttttgc

SEQ ID NO: 1408229 - DNA, 22 bp, Artificial Sequence
  chemically synthesized
ttagaaccctttctctgttttg

SEQ ID NO: 1408230 - DNA, 22 bp, Artificial Sequence
  chemically synthesized
cgtacgatttttagaacccttt

SEQ ID NO: 1408231 - DNA, 22 bp, Artificial Sequence
  chemically synthesized
caaaacagagaaagggttctaa

SEQ ID NO: 1408232 - DNA, 22 bp, Artificial Sequence
  chemically synthesized
cctgcgtacgatttttagaacc

SEQ ID NO: 1408233 - DNA, 22 bp, Artificial Sequence
  chemically synthesized
gcctgcgtacgatttttagaac

SEQ ID NO: 1408234 - DNA, 22 bp, Artificial Sequence
  chemically synthesized
ttgcctgcgtacgatttttaga

SEQ ID NO: 1408235 - DNA, 22 bp, Artificial Sequence
  chemically synthesized
cttgcctgcgtacgatttttag

SEQ ID NO: 1408236 - DNA, 22 bp, Artificial Sequence
  chemically synthesized
tcttgcctgcgtacgattttta

SEQ ID NO: 1408237 - DNA, 22 bp, Artificial Sequence
  chemically synthesized
tttcttgcctgcgtacgatttt

SEQ ID NO: 1408238 - DNA, 22 bp, Artificial Sequence
  chemically synthesized
cattctttcttgcctgcgtacg

SEQ ID NO: 1408239 - DNA, 22 bp, Artificial Sequence
  chemically synthesized
acattctttcttgcctgcgtac

SEQ ID NO: 1408240 - DNA, 22 bp, Artificial Sequence
  chemically synthesized
taaaaatcgtacgcaggcaaga

SEQ ID NO: 1408241 - DNA, 22 bp, Artificial Sequence
  chemically synthesized
tcttacattctttcttgcctgc

SEQ ID NO: 1408242 - DNA, 22 bp, Artificial Sequence
  chemically synthesized
gtcttacattctttcttgcctg

SEQ ID NO: 1408243 - DNA, 22 bp, Artificial Sequence
  chemically synthesized
aaaatcgtacgcaggcaagaaa

SEQ ID NO: 1408244 - DNA, 22 bp, Artificial Sequence
  chemically synthesized
tgtcttacattctttcttgcct

SEQ ID NO: 1408245 - DNA, 22 bp, Artificial Sequence
  chemically synthesized
atgagttttgtcttacattctt

SEQ ID NO: 1408246 - DNA, 22 bp, Artificial Sequence
  chemically synthesized
aatgagttttgtcttacattct

SEQ ID NO: 1408247 - DNA, 22 bp, Artificial Sequence
  chemically synthesized
taatgagttttgtcttacattc

SEQ ID NO: 1408248 - DNA, 22 bp, Artificial Sequence
  chemically synthesized
ccctttaatgagttttgtctta

SEQ ID NO: 1408249 - DNA, 22 bp, Artificial Sequence
  chemically synthesized
gccctttaatgagttttgtctt

SEQ ID NO: 1408250 - DNA, 22 bp, Artificial Sequence
  chemically synthesized
tgccctttaatgagttttgtct

SEQ ID NO: 1408251 - DNA, 22 bp, Artificial Sequence
  chemically synthesized
ttttgccctttaatgagttttg

SEQ ID NO: 1408252 - DNA, 22 bp, Artificial Sequence
  chemically synthesized
attttgccctttaatgagtttt

SEQ ID NO: 1408253 - DNA, 22 bp, Artificial Sequence
  chemically synthesized
tttattttgccctttaatgagt

SEQ ID NO: 1408254 - DNA, 22 bp, Artificial Sequence
  chemically synthesized
atttattttgccctttaatgag

SEQ ID NO: 1408255 - DNA, 22 bp, Artificial Sequence
  chemically synthesized
tttatttattttgccctttaat

SEQ ID NO: 1408256 - DNA, 22 bp, Artificial Sequence
  chemically synthesized
atttatttattttgccctttaa

SEQ ID NO: 1408257 - DNA, 22 bp, Artificial Sequence
  chemically synthesized
tttatttatttattttgccctt

SEQ ID NO: 1408258 - DNA, 22 bp, Artificial Sequence
  chemically synthesized
atttatttatttattttgccct

SEQ ID NO: 1408259 - DNA, 22 bp, Artificial Sequence
  chemically synthesized
tttatttatttatttattttgc

SEQ ID NO: 1408260 - DNA, 22 bp, Artificial Sequence
  chemically synthesized
atttatttatttatttattttg

SEQ ID NO: 1408261 - DNA, 22 bp, Artificial Sequence
  chemically synthesized
attaaagggcaaaataaataaa

SEQ ID NO: 1408262 - DNA, 22 bp, Artificial Sequence
  chemically synthesized
tttatttatttatttatttatt

SEQ ID NO: 1408263 - DNA, 22 bp, Artificial Sequence
  chemically synthesized
atttatttatttatttatttat

SEQ ID NO: 1408264 - DNA, 22 bp, Artificial Sequence
  chemically synthesized
aagggcaaaataaataaataaa

SEQ ID NO: 1408265 - DNA, 22 bp, Artificial Sequence
  chemically synthesized
tttatttatttatttatttatt

SEQ ID NO: 1408266 - DNA, 22 bp, Artificial Sequence
  chemically synthesized
atttatttatttatttatttat

SEQ ID NO: 1408267 - DNA, 22 bp, Artificial Sequence
  chemically synthesized
tttatttatttatttatttatt

SEQ ID NO: 1408268 - DNA, 22 bp, Artificial Sequence
  chemically synthesized
atttatttatttatttatttat

SEQ ID NO: 1408269 - DNA, 22 bp, Artificial Sequence
  chemically synthesized
aaaatgtgagcatttatttatt

SEQ ID NO: 1408270 - DNA, 22 bp, Artificial Sequence
  chemically synthesized
ttgaaaatgtgagcatttattt

SEQ ID NO: 1408271 - DNA, 22 bp, Artificial Sequence
  chemically synthesized
acattttcaataatttatcact

SEQ ID NO: 1408272 - DNA, 22 bp, Artificial Sequence
  chemically synthesized
atgaaaaatgacagaagtgata

SEQ ID NO: 1408273 - DNA, 22 bp, Artificial Sequence
  chemically synthesized
tcaataatttatcacttctgtc

SEQ ID NO: 1408274 - DNA, 22 bp, Artificial Sequence
  chemically synthesized
ttaatgaaaaatgacagaagtg

SEQ ID NO: 1408275 - DNA, 22 bp, Artificial Sequence
  chemically synthesized
caataatttatcacttctgtca

SEQ ID NO: 1408276 - DNA, 22 bp, Artificial Sequence
  chemically synthesized
aataatttatcacttctgtcat

SEQ ID NO: 1408277 - DNA, 22 bp, Artificial Sequence
  chemically synthesized
aaggctgttaatgaaaaatgac

SEQ ID NO: 1408278 - DNA, 22 bp, Artificial Sequence
  chemically synthesized
gaaggctgttaatgaaaaatga

SEQ ID NO: 1408279 - DNA, 22 bp, Artificial Sequence
  chemically synthesized
tgaaggctgttaatgaaaaatg

SEQ ID NO: 1408280 - DNA, 22 bp, Artificial Sequence
  chemically synthesized
atcacttctgtcatttttcatt

SEQ ID NO: 1408281 - DNA, 22 bp, Artificial Sequence
  chemically synthesized
tcacttctgtcatttttcatta

SEQ ID NO: 1408282 - DNA, 22 bp, Artificial Sequence
  chemically synthesized
ctgtcatttttcattaacagcc

SEQ ID NO: 1408283 - DNA, 22 bp, Artificial Sequence
  chemically synthesized
tgtcatttttcattaacagcct

SEQ ID NO: 1408284 - DNA, 22 bp, Artificial Sequence
  chemically synthesized
tcatttttcattaacagccttc

SEQ ID NO: 1408285 - DNA, 22 bp, Artificial Sequence
  chemically synthesized
agatagggctttgaaggctgtt

SEQ ID NO: 1408286 - DNA, 22 bp, Artificial Sequence
  chemically synthesized
cagatagggctttgaaggctgt

SEQ ID NO: 1408287 - DNA, 22 bp, Artificial Sequence
  chemically synthesized
tttcagatagggctttgaaggc

SEQ ID NO: 1408288 - DNA, 22 bp, Artificial Sequence
  chemically synthesized
gtttcagatagggctttgaagg

SEQ ID NO: 1408289 - DNA, 22 bp, Artificial Sequence
  chemically synthesized
ttcattaacagccttcaaagcc

SEQ ID NO: 1408290 - DNA, 22 bp, Artificial Sequence
  chemically synthesized
tcattaacagccttcaaagccc

SEQ ID NO: 1408291 - DNA, 22 bp, Artificial Sequence
  chemically synthesized
cattaacagccttcaaagccct

SEQ ID NO: 1408292 - DNA, 22 bp, Artificial Sequence
  chemically synthesized
attaacagccttcaaagcccta

SEQ ID NO: 1408293 - DNA, 22 bp, Artificial Sequence
  chemically synthesized
acagccttcaaagccctatctg

SEQ ID NO: 1408294 - DNA, 22 bp, Artificial Sequence
  chemically synthesized
tatcagcttgtttcagataggg

SEQ ID NO: 1408295 - DNA, 22 bp, Artificial Sequence
  chemically synthesized
tgtatcagcttgtttcagatag

SEQ ID NO: 1408296 - DNA, 22 bp, Artificial Sequence
  chemically synthesized
tctgtatcagcttgtttcagat

SEQ ID NO: 1408297 - DNA, 22 bp, Artificial Sequence
  chemically synthesized
ctctgtatcagcttgtttcaga

SEQ ID NO: 1408298 - DNA, 22 bp, Artificial Sequence
  chemically synthesized
caaagccctatctgaaacaagc

SEQ ID NO: 1408299 - DNA, 22 bp, Artificial Sequence
  chemically synthesized
aaagccctatctgaaacaagct

SEQ ID NO: 1408300 - DNA, 22 bp, Artificial Sequence
  chemically synthesized
atttctctgtatcagcttgttt

SEQ ID NO: 1408301 - DNA, 22 bp, Artificial Sequence
  chemically synthesized
aatttctctgtatcagcttgtt

SEQ ID NO: 1408302 - DNA, 22 bp, Artificial Sequence
  chemically synthesized
ttaatttctctgtatcagcttg

SEQ ID NO: 1408303 - DNA, 22 bp, Artificial Sequence
  chemically synthesized
ctcttaatttctctgtatcagc

SEQ ID NO: 1408304 - DNA, 22 bp, Artificial Sequence
  chemically synthesized
tctgaaacaagctgatacagag

SEQ ID NO: 1408305 - DNA, 22 bp, Artificial Sequence
  chemically synthesized
ctgctcttaatttctctgtatc

SEQ ID NO: 1408306 - DNA, 22 bp, Artificial Sequence
  chemically synthesized
aaacaagctgatacagagaaat

SEQ ID NO: 1408307 - DNA, 22 bp, Artificial Sequence
  chemically synthesized
attactgctcttaatttctctg

SEQ ID NO: 1408308 - DNA, 22 bp, Artificial Sequence
  chemically synthesized
gattactgctcttaatttctct

SEQ ID NO: 1408309 - DNA, 22 bp, Artificial Sequence
  chemically synthesized
gcttgattactgctcttaattt

SEQ ID NO: 1408310 - DNA, 22 bp, Artificial Sequence
  chemically synthesized
tcgcttgattactgctcttaat

SEQ ID NO: 1408311 - DNA, 22 bp, Artificial Sequence
  chemically synthesized
ctcgcttgattactgctcttaa

SEQ ID NO: 1408312 - DNA, 22 bp, Artificial Sequence
  chemically synthesized
atacagagaaattaagagcagt

SEQ ID NO: 1408313 - DNA, 22 bp, Artificial Sequence
  chemically synthesized
tgatttctcgcttgattactgc

SEQ ID NO: 1408314 - DNA, 22 bp, Artificial Sequence
  chemically synthesized
gtctatgatttctcgcttgatt

SEQ ID NO: 1408315 - DNA, 22 bp, Artificial Sequence
  chemically synthesized
agagcagtaatcaagcgagaaa

SEQ ID NO: 1408316 - DNA, 22 bp, Artificial Sequence
  chemically synthesized
atgtcgacccagctggtctatg

SEQ ID NO: 1408317 - DNA, 22 bp, Artificial Sequence
  chemically synthesized
ccaagttgatgtcgacccagct

SEQ ID NO: 1408318 - DNA, 22 bp, Artificial Sequence
  chemically synthesized
gccaagttgatgtcgacccagc

SEQ ID NO: 1408319 - DNA, 22 bp, Artificial Sequence
  chemically synthesized
tgccaagttgatgtcgacccag

SEQ ID NO: 1408320 - DNA, 22 bp, Artificial Sequence
  chemically synthesized
acgttttgccaagttgatgtcg

SEQ ID NO: 1408321 - DNA, 22 bp, Artificial Sequence
  chemically synthesized
tattcacgttttgccaagttga

SEQ ID NO: 1408322 - DNA, 22 bp, Artificial Sequence
  chemically synthesized
ggtcgacatcaacttggcaaaa

SEQ ID NO: 1408323 - DNA, 22 bp, Artificial Sequence
  chemically synthesized
aactgtattcacgttttgccaa

SEQ ID NO: 1408324 - DNA, 22 bp, Artificial Sequence
  chemically synthesized
ttgaactgtattcacgttttgc

SEQ ID NO: 1408325 - DNA, 22 bp, Artificial Sequence
  chemically synthesized
agctattgaactgtattcacgt

SEQ ID NO: 1408326 - DNA, 22 bp, Artificial Sequence
  chemically synthesized
cagctattgaactgtattcacg

SEQ ID NO: 1408327 - DNA, 22 bp, Artificial Sequence
  chemically synthesized
tttcagctattgaactgtattc

SEQ ID NO: 1408328 - DNA, 22 bp, Artificial Sequence
  chemically synthesized
ggcaaaacgtgaatacagttca

SEQ ID NO: 1408329 - DNA, 22 bp, Artificial Sequence
  chemically synthesized
gcaaaacgtgaatacagttcaa

SEQ ID NO: 1408330 - DNA, 22 bp, Artificial Sequence
  chemically synthesized
gcatctgtttcagctattgaac

SEQ ID NO: 1408331 - DNA, 22 bp, Artificial Sequence
  chemically synthesized
tagcatctgtttcagctattga

SEQ ID NO: 1408332 - DNA, 22 bp, Artificial Sequence
  chemically synthesized
aacaactctagcatctgtttca

SEQ ID NO: 1408333 - DNA, 22 bp, Artificial Sequence
  chemically synthesized
caacaactctagcatctgtttc

SEQ ID NO: 1408334 - DNA, 22 bp, Artificial Sequence
  chemically synthesized
tcaacaactctagcatctgttt

SEQ ID NO: 1408335 - DNA, 22 bp, Artificial Sequence
  chemically synthesized
ttcaacaactctagcatctgtt

SEQ ID NO: 1408336 - DNA, 22 bp, Artificial Sequence
  chemically synthesized
aatagctgaaacagatgctaga

SEQ ID NO: 1408337 - DNA, 22 bp, Artificial Sequence
  chemically synthesized
cagggtttttcaacaactctag

SEQ ID NO: 1408338 - DNA, 22 bp, Artificial Sequence
  chemically synthesized
aaacagatgctagagttgttga

SEQ ID NO: 1408339 - DNA, 22 bp, Artificial Sequence
  chemically synthesized
ctgcagggtttttcaacaactc

SEQ ID NO: 1408340 - DNA, 22 bp, Artificial Sequence
  chemically synthesized
gagttgttgaaaaaccctgcag

SEQ ID NO: 1408341 - DNA, 22 bp, Artificial Sequence
  chemically synthesized
ttgaaaaaccctgcaggagata

SEQ ID NO: 1408342 - DNA, 22 bp, Artificial Sequence
  chemically synthesized
aaaaaccctgcaggagatattg

SEQ ID NO: 1408343 - DNA, 22 bp, Artificial Sequence
  chemically synthesized
tatgaagaaaatatatcaatat

SEQ ID NO: 1408344 - DNA, 22 bp, Artificial Sequence
  chemically synthesized
cattatatgaagaaaatatatc

SEQ ID NO: 1408345 - DNA, 22 bp, Artificial Sequence
  chemically synthesized
caggagatattgatatattttc

SEQ ID NO: 1408346 - DNA, 22 bp, Artificial Sequence
  chemically synthesized
tgcattatatgaagaaaatata

SEQ ID NO: 1408347 - DNA, 22 bp, Artificial Sequence
  chemically synthesized
agtcattctgcattatatgaag

SEQ ID NO: 1408348 - DNA, 22 bp, Artificial Sequence
  chemically synthesized
atatattttcttcatataatgc

SEQ ID NO: 1408349 - DNA, 22 bp, Artificial Sequence
  chemically synthesized
ttcagtcattctgcattatatg

SEQ ID NO: 1408350 - DNA, 22 bp, Artificial Sequence
  chemically synthesized
attcagtcattctgcattatat

SEQ ID NO: 1408351 - DNA, 22 bp, Artificial Sequence
  chemically synthesized
acatttattcagtcattctgca

SEQ ID NO: 1408352 - DNA, 22 bp, Artificial Sequence
  chemically synthesized
tcttcatataatgcagaatgac

SEQ ID NO: 1408353 - DNA, 22 bp, Artificial Sequence
  chemically synthesized
gacatttattcagtcattctgc

SEQ ID NO: 1408354 - DNA, 22 bp, Artificial Sequence
  chemically synthesized
cttcatataatgcagaatgact

SEQ ID NO: 1408355 - DNA, 22 bp, Artificial Sequence
  chemically synthesized
tgacatttattcagtcattctg

SEQ ID NO: 1408356 - DNA, 22 bp, Artificial Sequence
  chemically synthesized
ttcatataatgcagaatgactg

SEQ ID NO: 1408357 - DNA, 22 bp, Artificial Sequence
  chemically synthesized
ttgacatttattcagtcattct

SEQ ID NO: 1408358 - DNA, 22 bp, Artificial Sequence
  chemically synthesized
catataatgcagaatgactgaa

SEQ ID NO: 1408359 - DNA, 22 bp, Artificial Sequence
  chemically synthesized
atataatgcagaatgactgaat

SEQ ID NO: 1408360 - DNA, 22 bp, Artificial Sequence
  chemically synthesized
gcttttgacatttattcagtca

SEQ ID NO: 1408361 - DNA, 22 bp, Artificial Sequence
  chemically synthesized
tagcttttgacatttattcagt

SEQ ID NO: 1408362 - DNA, 22 bp, Artificial Sequence
  chemically synthesized
ctagcttttgacatttattcag

SEQ ID NO: 1408363 - DNA, 22 bp, Artificial Sequence
  chemically synthesized
atcaatttctagcttttgacat

SEQ ID NO: 1408364 - DNA, 22 bp, Artificial Sequence
  chemically synthesized
ctcatcaatttctagcttttga

SEQ ID NO: 1408365 - DNA, 22 bp, Artificial Sequence
  chemically synthesized
tcctcatcaatttctagctttt

SEQ ID NO: 1408366 - DNA, 22 bp, Artificial Sequence
  chemically synthesized
ctcctcatcaatttctagcttt

SEQ ID NO: 1408367 - DNA, 22 bp, Artificial Sequence
  chemically synthesized
aataaatgtcaaaagctagaaa

SEQ ID NO: 1408368 - DNA, 22 bp, Artificial Sequence
  chemically synthesized
tcagtcatttctcctcatcaat

SEQ ID NO: 1408369 - DNA, 22 bp, Artificial Sequence
  chemically synthesized
gctgtcagtcatttctcctcat

SEQ ID NO: 1408370 - DNA, 22 bp, Artificial Sequence
  chemically synthesized
ggctgtcagtcatttctcctca

SEQ ID NO: 1408371 - DNA, 22 bp, Artificial Sequence
  chemically synthesized
gaaattgatgaggagaaatgac

SEQ ID NO: 1408372 - DNA, 22 bp, Artificial Sequence
  chemically synthesized
taaggagtttggctgtcagtca

SEQ ID NO: 1408373 - DNA, 22 bp, Artificial Sequence
  chemically synthesized
atgaggagaaatgactgacagc

SEQ ID NO: 1408374 - DNA, 22 bp, Artificial Sequence
  chemically synthesized
ataaggagtttggctgtcagtc

SEQ ID NO: 1408375 - DNA, 22 bp, Artificial Sequence
  chemically synthesized
tataaggagtttggctgtcagt

SEQ ID NO: 1408376 - DNA, 22 bp, Artificial Sequence
  chemically synthesized
ttttataaggagtttggctgtc

SEQ ID NO: 1408377 - DNA, 22 bp, Artificial Sequence
  chemically synthesized
tattttataaggagtttggctg

SEQ ID NO: 1408378 - DNA, 22 bp, Artificial Sequence
  chemically synthesized
ctattttataaggagtttggct

SEQ ID NO: 1408379 - DNA, 22 bp, Artificial Sequence
  chemically synthesized
gtttctattttataaggagttt

SEQ ID NO: 1408380 - DNA, 22 bp, Artificial Sequence
  chemically synthesized
ggtttctattttataaggagtt

SEQ ID NO: 1408381 - DNA, 22 bp, Artificial Sequence
  chemically synthesized
acagccaaactccttataaaat

SEQ ID NO: 1408382 - DNA, 22 bp, Artificial Sequence
  chemically synthesized
tacttggtttctattttataag

SEQ ID NO: 1408383 - DNA, 22 bp, Artificial Sequence
  chemically synthesized
ttatacttggtttctattttat

SEQ ID NO: 1408384 - DNA, 22 bp, Artificial Sequence
  chemically synthesized
aaaattgttatacttggtttct

SEQ ID NO: 1408385 - DNA, 22 bp, Artificial Sequence
  chemically synthesized
cttataaaatagaaaccaagta

SEQ ID NO: 1408386 - DNA, 22 bp, Artificial Sequence
  chemically synthesized
ataaaatagaaaccaagtataa

SEQ ID NO: 1408387 - DNA, 22 bp, Artificial Sequence
  chemically synthesized
taaaatagaaaccaagtataac

SEQ ID NO: 1408388 - DNA, 22 bp, Artificial Sequence
  chemically synthesized
gataggttgaaaattgttatac

SEQ ID NO: 1408389 - DNA, 22 bp, Artificial Sequence
  chemically synthesized
ggataggttgaaaattgttata

SEQ ID NO: 1408390 - DNA, 22 bp, Artificial Sequence
  chemically synthesized
tcaacctatccaaacattctgt

SEQ ID NO: 1408391 - DNA, 22 bp, Artificial Sequence
  chemically synthesized
caacctatccaaacattctgta

SEQ ID NO: 1408392 - DNA, 22 bp, Artificial Sequence
  chemically synthesized
aacctatccaaacattctgtac

SEQ ID NO: 1408393 - DNA, 22 bp, Artificial Sequence
  chemically synthesized
tccaaacattctgtacattctc

SEQ ID NO: 1408394 - DNA, 22 bp, Artificial Sequence
  chemically synthesized
agacagtgagagaaatgagaat

SEQ ID NO: 1408395 - DNA, 22 bp, Artificial Sequence
  chemically synthesized
tgtacattctcatttctctcac

SEQ ID NO: 1408396 - DNA, 22 bp, Artificial Sequence
  chemically synthesized
gcatattcagacagtgagagaa

SEQ ID NO: 1408397 - DNA, 22 bp, Artificial Sequence
  chemically synthesized
tacattctcatttctctcactg

SEQ ID NO: 1408398 - DNA, 22 bp, Artificial Sequence
  chemically synthesized
tcatttctctcactgtctgaat

SEQ ID NO: 1408399 - DNA, 22 bp, Artificial Sequence
  chemically synthesized
atgtattggcatattcagacag

SEQ ID NO: 1408400 - DNA, 22 bp, Artificial Sequence
  chemically synthesized
atttctctcactgtctgaatat

SEQ ID NO: 1408401 - DNA, 22 bp, Artificial Sequence
  chemically synthesized
attgatgtattggcatattcag

SEQ ID NO: 1408402 - DNA, 22 bp, Artificial Sequence
  chemically synthesized
ctctcactgtctgaatatgcca

SEQ ID NO: 1408403 - DNA, 22 bp, Artificial Sequence
  chemically synthesized
tctcactgtctgaatatgccaa

SEQ ID NO: 1408404 - DNA, 22 bp, Artificial Sequence
  chemically synthesized
tcactgtctgaatatgccaata

SEQ ID NO: 1408405 - DNA, 22 bp, Artificial Sequence
  chemically synthesized
actgtctgaatatgccaataca

SEQ ID NO: 1408406 - DNA, 22 bp, Artificial Sequence
  chemically synthesized
caagaactgattgatgtattgg

SEQ ID NO: 1408407 - DNA, 22 bp, Artificial Sequence
  chemically synthesized
tctgaatatgccaatacatcaa

SEQ ID NO: 1408408 - DNA, 22 bp, Artificial Sequence
  chemically synthesized
gttgcaagaactgattgatgta

SEQ ID NO: 1408409 - DNA, 22 bp, Artificial Sequence
  chemically synthesized
agttgcaagaactgattgatgt

SEQ ID NO: 1408410 - DNA, 22 bp, Artificial Sequence
  chemically synthesized
aatatgccaatacatcaatcag

SEQ ID NO: 1408411 - DNA, 22 bp, Artificial Sequence
  chemically synthesized
tatgcaatttagttgcaagaac

SEQ ID NO: 1408412 - DNA, 22 bp, Artificial Sequence
  chemically synthesized
gttatatgcaatttagttgcaa

SEQ ID NO: 1408413 - DNA, 22 bp, Artificial Sequence
  chemically synthesized
ccccagattagttatatgcaat

SEQ ID NO: 1408414 - DNA, 22 bp, Artificial Sequence
  chemically synthesized
ttgcaactaaattgcatataac

SEQ ID NO: 1408415 - DNA, 22 bp, Artificial Sequence
  chemically synthesized
gcaactaaattgcatataacta

SEQ ID NO: 1408416 - DNA, 22 bp, Artificial Sequence
  chemically synthesized
caactaaattgcatataactaa

SEQ ID NO: 1408417 - DNA, 22 bp, Artificial Sequence
  chemically synthesized
aattgcatataactaatctggg

SEQ ID NO: 1408418 - DNA, 22 bp, Artificial Sequence
  chemically synthesized
ggggaaatctaccccagattag

SEQ ID NO: 1408419 - DNA, 22 bp, Artificial Sequence
  chemically synthesized
cggggaaatctaccccagatta

SEQ ID NO: 1408420 - DNA, 22 bp, Artificial Sequence
  chemically synthesized
catataactaatctggggtaga

SEQ ID NO: 1408421 - DNA, 22 bp, Artificial Sequence
  chemically synthesized
atctggggtagatttccccgaa

SEQ ID NO: 1408422 - DNA, 22 bp, Artificial Sequence
  chemically synthesized
gggtagatttccccgaagattt

SEQ ID NO: 1408423 - DNA, 22 bp, Artificial Sequence
  chemically synthesized
ccccgaagatttttttccccct

SEQ ID NO: 1408424 - DNA, 22 bp, Artificial Sequence
  chemically synthesized
cccgaagatttttttccccctg

SEQ ID NO: 1408425 - DNA, 22 bp, Artificial Sequence
  chemically synthesized
aggtagatgatgacagggggaa

SEQ ID NO: 1408426 - DNA, 22 bp, Artificial Sequence
  chemically synthesized
caggtagatgatgacaggggga

SEQ ID NO: 1408427 - DNA, 22 bp, Artificial Sequence
  chemically synthesized
ttcaggtagatgatgacagggg

SEQ ID NO: 1408428 - DNA, 22 bp, Artificial Sequence
  chemically synthesized
cttcaggtagatgatgacaggg

SEQ ID NO: 1408429 - DNA, 22 bp, Artificial Sequence
  chemically synthesized
ggtttcttcaggtagatgatga

SEQ ID NO: 1408430 - DNA, 22 bp, Artificial Sequence
  chemically synthesized
ttttccccctgtcatcatctac

SEQ ID NO: 1408431 - DNA, 22 bp, Artificial Sequence
  chemically synthesized
tttccccctgtcatcatctacc

SEQ ID NO: 1408432 - DNA, 22 bp, Artificial Sequence
  chemically synthesized
ttccccctgtcatcatctacct

SEQ ID NO: 1408433 - DNA, 22 bp, Artificial Sequence
  chemically synthesized
tccccctgtcatcatctacctg

SEQ ID NO: 1408434 - DNA, 22 bp, Artificial Sequence
  chemically synthesized
ccccctgtcatcatctacctga

SEQ ID NO: 1408435 - DNA, 22 bp, Artificial Sequence
  chemically synthesized
cccctgtcatcatctacctgaa

SEQ ID NO: 1408436 - DNA, 22 bp, Artificial Sequence
  chemically synthesized
aggagtctaggtttcttcaggt

SEQ ID NO: 1408437 - DNA, 22 bp, Artificial Sequence
  chemically synthesized
tcatcatctacctgaagaaacc

SEQ ID NO: 1408438 - DNA, 22 bp, Artificial Sequence
  chemically synthesized
ttcaggagtctaggtttcttca

SEQ ID NO: 1408439 - DNA, 22 bp, Artificial Sequence
  chemically synthesized
cctgaagaaacctagactcctg

SEQ ID NO: 1408440 - DNA, 22 bp, Artificial Sequence
  chemically synthesized
gaataaagtattgttcaggagt

SEQ ID NO: 1408441 - DNA, 22 bp, Artificial Sequence
  chemically synthesized
aagaaacctagactcctgaaca

SEQ ID NO: 1408442 - DNA, 22 bp, Artificial Sequence
  chemically synthesized
agaataaagtattgttcaggag

SEQ ID NO: 1408443 - DNA, 22 bp, Artificial Sequence
  chemically synthesized
tagaataaagtattgttcagga

SEQ ID NO: 1408444 - DNA, 22 bp, Artificial Sequence
  chemically synthesized
gaagattttagaataaagtatt

SEQ ID NO: 1408445 - DNA, 22 bp, Artificial Sequence
  chemically synthesized
gactcctgaacaatactttatt

SEQ ID NO: 1408446 - DNA, 22 bp, Artificial Sequence
  chemically synthesized
ctgaacaatactttattctaaa

SEQ ID NO: 1408447 - DNA, 22 bp, Artificial Sequence
  chemically synthesized
aacaatactttattctaaaatc

SEQ ID NO: 1408448 - DNA, 22 bp, Artificial Sequence
  chemically synthesized
ggatagaaatcagtgttagaag

SEQ ID NO: 1408449 - DNA, 22 bp, Artificial Sequence
  chemically synthesized
tattctaaaatcttctaacact

SEQ ID NO: 1408450 - DNA, 22 bp, Artificial Sequence
  chemically synthesized
attctaaaatcttctaacactg

SEQ ID NO: 1408451 - DNA, 22 bp, Artificial Sequence
  chemically synthesized
tgggatagaaatcagtgttaga

SEQ ID NO: 1408452 - DNA, 22 bp, Artificial Sequence
  chemically synthesized
ttctaaaatcttctaacactga

SEQ ID NO: 1408453 - DNA, 22 bp, Artificial Sequence
  chemically synthesized
ctgggatagaaatcagtgttag

SEQ ID NO: 1408454 - DNA, 22 bp, Artificial Sequence
  chemically synthesized
taaaatcttctaacactgattt

SEQ ID NO: 1408455 - DNA, 22 bp, Artificial Sequence
  chemically synthesized
aaatcttctaacactgatttct

SEQ ID NO: 1408456 - DNA, 22 bp, Artificial Sequence
  chemically synthesized
ctaacactgatttctatcccag

SEQ ID NO: 1408457 - DNA, 22 bp, Artificial Sequence
  chemically synthesized
aggaaaacacttctgggataga

SEQ ID NO: 1408458 - DNA, 22 bp, Artificial Sequence
  chemically synthesized
taacactgatttctatcccaga

SEQ ID NO: 1408459 - DNA, 22 bp, Artificial Sequence
  chemically synthesized
acactgatttctatcccagaag

SEQ ID NO: 1408460 - DNA, 22 bp, Artificial Sequence
  chemically synthesized
caacctcaggaaaacacttctg

SEQ ID NO: 1408461 - DNA, 22 bp, Artificial Sequence
  chemically synthesized
atttctatcccagaagtgtttt

SEQ ID NO: 1408462 - DNA, 22 bp, Artificial Sequence
  chemically synthesized
cctccaacctcaggaaaacact

SEQ ID NO: 1408463 - DNA, 22 bp, Artificial Sequence
  chemically synthesized
gcctccaacctcaggaaaacac

SEQ ID NO: 1408464 - DNA, 22 bp, Artificial Sequence
  chemically synthesized
ctatcccagaagtgttttcctg

SEQ ID NO: 1408465 - DNA, 22 bp, Artificial Sequence
  chemically synthesized
tatcccagaagtgttttcctga

SEQ ID NO: 1408466 - DNA, 22 bp, Artificial Sequence
  chemically synthesized
tcccagaagtgttttcctgagg

SEQ ID NO: 1408467 - DNA, 22 bp, Artificial Sequence
  chemically synthesized
gggagggggtgtgcttgcctcc

SEQ ID NO: 1408468 - DNA, 22 bp, Artificial Sequence
  chemically synthesized
ggggagggggtgtgcttgcctc

SEQ ID NO: 1408469 - DNA, 22 bp, Artificial Sequence
  chemically synthesized
tcctgaggttggaggcaagcac

SEQ ID NO: 1408470 - DNA, 22 bp, Artificial Sequence
  chemically synthesized
tggggagggggtgtgcttgcct

SEQ ID NO: 1408471 - DNA, 22 bp, Artificial Sequence
  chemically synthesized
cctgaggttggaggcaagcaca

SEQ ID NO: 1408472 - DNA, 22 bp, Artificial Sequence
  chemically synthesized
ctgaggttggaggcaagcacac

SEQ ID NO: 1408473 - DNA, 22 bp, Artificial Sequence
  chemically synthesized
aggttggaggcaagcacacccc

SEQ ID NO: 1408474 - DNA, 22 bp, Artificial Sequence
  chemically synthesized
gattttggggagggggtgtgct

SEQ ID NO: 1408475 - DNA, 22 bp, Artificial Sequence
  chemically synthesized
cgttagattttggggagggggt

SEQ ID NO: 1408476 - DNA, 22 bp, Artificial Sequence
  chemically synthesized
gaggcaagcacaccccctcccc

SEQ ID NO: 1408477 - DNA, 22 bp, Artificial Sequence
  chemically synthesized
tgctgcgttagattttggggag

SEQ ID NO: 1408478 - DNA, 22 bp, Artificial Sequence
  chemically synthesized
gtgctgcgttagattttgggga

SEQ ID NO: 1408479 - DNA, 22 bp, Artificial Sequence
  chemically synthesized
ccttgtgctgcgttagattttg

SEQ ID NO: 1408480 - DNA, 22 bp, Artificial Sequence
  chemically synthesized
aaattgccttgtgctgcgttag

SEQ ID NO: 1408481 - DNA, 22 bp, Artificial Sequence
  chemically synthesized
aaaattgccttgtgctgcgtta

SEQ ID NO: 1408482 - DNA, 22 bp, Artificial Sequence
  chemically synthesized
taaaattgccttgtgctgcgtt

SEQ ID NO: 1408483 - DNA, 22 bp, Artificial Sequence
  chemically synthesized
cccaaaatctaacgcagcacaa

SEQ ID NO: 1408484 - DNA, 22 bp, Artificial Sequence
  chemically synthesized
cagaatggattttaaaattgcc

SEQ ID NO: 1408485 - DNA, 22 bp, Artificial Sequence
  chemically synthesized
acgcagcacaaggcaattttaa

SEQ ID NO: 1408486 - DNA, 22 bp, Artificial Sequence
  chemically synthesized
acagaatggattttaaaattgc

SEQ ID NO: 1408487 - DNA, 22 bp, Artificial Sequence
  chemically synthesized
tacagaatggattttaaaattg

SEQ ID NO: 1408488 - DNA, 22 bp, Artificial Sequence
  chemically synthesized
ttacagaatggattttaaaatt

SEQ ID NO: 1408489 - DNA, 22 bp, Artificial Sequence
  chemically synthesized
cttttacagaatggattttaaa

SEQ ID NO: 1408490 - DNA, 22 bp, Artificial Sequence
  chemically synthesized
caaacagtgttgcttttacaga

SEQ ID NO: 1408491 - DNA, 22 bp, Artificial Sequence
  chemically synthesized
taaaatccattctgtaaaagca

SEQ ID NO: 1408492 - DNA, 22 bp, Artificial Sequence
  chemically synthesized
tgcaaacagtgttgcttttaca

SEQ ID NO: 1408493 - DNA, 22 bp, Artificial Sequence
  chemically synthesized
aaaatccattctgtaaaagcaa

SEQ ID NO: 1408494 - DNA, 22 bp, Artificial Sequence
  chemically synthesized
aaatccattctgtaaaagcaac

SEQ ID NO: 1408495 - DNA, 22 bp, Artificial Sequence
  chemically synthesized
aaactctgcaaacagtgttgct

SEQ ID NO: 1408496 - DNA, 22 bp, Artificial Sequence
  chemically synthesized
caaactctgcaaacagtgttgc

SEQ ID NO: 1408497 - DNA, 22 bp, Artificial Sequence
  chemically synthesized
ttcaaactctgcaaacagtgtt

SEQ ID NO: 1408498 - DNA, 22 bp, Artificial Sequence
  chemically synthesized
tgtaaaagcaacactgtttgca

SEQ ID NO: 1408499 - DNA, 22 bp, Artificial Sequence
  chemically synthesized
taaaagcaacactgtttgcaga

SEQ ID NO: 1408500 - DNA, 22 bp, Artificial Sequence
  chemically synthesized
ccgagctcttcaaactctgcaa

SEQ ID NO: 1408501 - DNA, 22 bp, Artificial Sequence
  chemically synthesized
ttgccgagctcttcaaactctg

SEQ ID NO: 1408502 - DNA, 22 bp, Artificial Sequence
  chemically synthesized
gttgccgagctcttcaaactct

SEQ ID NO: 1408503 - DNA, 22 bp, Artificial Sequence
  chemically synthesized
gggtttgttgccgagctcttca

SEQ ID NO: 1408504 - DNA, 22 bp, Artificial Sequence
  chemically synthesized
tttgcagagtttgaagagctcg

SEQ ID NO: 1408505 - DNA, 22 bp, Artificial Sequence
  chemically synthesized
gcagagtttgaagagctcggca

SEQ ID NO: 1408506 - DNA, 22 bp, Artificial Sequence
  chemically synthesized
cagagtttgaagagctcggcaa

SEQ ID NO: 1408507 - DNA, 22 bp, Artificial Sequence
  chemically synthesized
gtagctggggtttgttgccgag

SEQ ID NO: 1408508 - DNA, 22 bp, Artificial Sequence
  chemically synthesized
ttggtagctggggtttgttgcc

SEQ ID NO: 1408509 - DNA, 22 bp, Artificial Sequence
  chemically synthesized
gaagagctcggcaacaaacccc

SEQ ID NO: 1408510 - DNA, 22 bp, Artificial Sequence
  chemically synthesized
aagagctcggcaacaaacccca

SEQ ID NO: 1408511 - DNA, 22 bp, Artificial Sequence
  chemically synthesized
ggcaacaaaccccagctaccaa

SEQ ID NO: 1408512 - DNA, 22 bp, Artificial Sequence
  chemically synthesized
aacaagcagctgttggtagctg

SEQ ID NO: 1408513 - DNA, 22 bp, Artificial Sequence
  chemically synthesized
gaacaagcagctgttggtagct

SEQ ID NO: 1408514 - DNA, 22 bp, Artificial Sequence
  chemically synthesized
ccaacagctgcttgttcaaaca

SEQ ID NO: 1408515 - DNA, 22 bp, Artificial Sequence
  chemically synthesized
gccatgacaaagcatatgtttg

SEQ ID NO: 1408516 - DNA, 22 bp, Artificial Sequence
  chemically synthesized
cttgttcaaacatatgctttgt

SEQ ID NO: 1408517 - DNA, 22 bp, Artificial Sequence
  chemically synthesized
gaagctggccatgacaaagcat

SEQ ID NO: 1408518 - DNA, 22 bp, Artificial Sequence
  chemically synthesized
gttcaaacatatgctttgtcat

SEQ ID NO: 1408519 - DNA, 22 bp, Artificial Sequence
  chemically synthesized
ttcaaacatatgctttgtcatg

SEQ ID NO: 1408520 - DNA, 22 bp, Artificial Sequence
  chemically synthesized
aaacatatgctttgtcatggcc

SEQ ID NO: 1408521 - DNA, 22 bp, Artificial Sequence
  chemically synthesized
caaatacaattagaagctggcc

SEQ ID NO: 1408522 - DNA, 22 bp, Artificial Sequence
  chemically synthesized
tgtcatggccagcttctaattg

SEQ ID NO: 1408523 - DNA, 22 bp, Artificial Sequence
  chemically synthesized
gtcatggccagcttctaattgt

SEQ ID NO: 1408524 - DNA, 22 bp, Artificial Sequence
  chemically synthesized
tcatggccagcttctaattgta

SEQ ID NO: 1408525 - DNA, 22 bp, Artificial Sequence
  chemically synthesized
catcattacaaatacaattaga

SEQ ID NO: 1408526 - DNA, 22 bp, Artificial Sequence
  chemically synthesized
ttacatcattacaaatacaatt

SEQ ID NO: 1408527 - DNA, 22 bp, Artificial Sequence
  chemically synthesized
aagctattacatcattacaaat

SEQ ID NO: 1408528 - DNA, 22 bp, Artificial Sequence
  chemically synthesized
ttaaagctattacatcattaca

SEQ ID NO: 1408529 - DNA, 22 bp, Artificial Sequence
  chemically synthesized
ctaattgtatttgtaatgatgt

SEQ ID NO: 1408530 - DNA, 22 bp, Artificial Sequence
  chemically synthesized
taattgtatttgtaatgatgta

SEQ ID NO: 1408531 - DNA, 22 bp, Artificial Sequence
  chemically synthesized
attgtatttgtaatgatgtaat

SEQ ID NO: 1408532 - DNA, 22 bp, Artificial Sequence
  chemically synthesized
tatttgtaatgatgtaatagct

SEQ ID NO: 1408533 - DNA, 22 bp, Artificial Sequence
  chemically synthesized
gtaatgatgtaatagctttaat

SEQ ID NO: 1408534 - DNA, 22 bp, Artificial Sequence
  chemically synthesized
taatgatgtaatagctttaata

SEQ ID NO: 1408535 - DNA, 22 bp, Artificial Sequence
  chemically synthesized
gcatggaaggtaggattattaa

SEQ ID NO: 1408536 - DNA, 22 bp, Artificial Sequence
  chemically synthesized
taataatcctaccttccatgcc

SEQ ID NO: 1408537 - DNA, 22 bp, Artificial Sequence
  chemically synthesized
aataatcctaccttccatgcca

SEQ ID NO: 1408538 - DNA, 22 bp, Artificial Sequence
  chemically synthesized
ataatcctaccttccatgccag

SEQ ID NO: 1408539 - DNA, 22 bp, Artificial Sequence
  chemically synthesized
ccttccatgccagctgtttttc

SEQ ID NO: 1408540 - DNA, 22 bp, Artificial Sequence
  chemically synthesized
ccatgccagctgtttttcctgt

SEQ ID NO: 1408541 - DNA, 22 bp, Artificial Sequence
  chemically synthesized
catgccagctgtttttcctgtc

SEQ ID NO: 1408542 - DNA, 22 bp, Artificial Sequence
  chemically synthesized
gcatgatggagtgacaggaaaa

SEQ ID NO: 1408543 - DNA, 22 bp, Artificial Sequence
  chemically synthesized
ttggcatgatggagtgacagga

SEQ ID NO: 1408544 - DNA, 22 bp, Artificial Sequence
  chemically synthesized
attggcatgatggagtgacagg

SEQ ID NO: 1408545 - DNA, 22 bp, Artificial Sequence
  chemically synthesized
tttttcctgtcactccatcatg

SEQ ID NO: 1408546 - DNA, 22 bp, Artificial Sequence
  chemically synthesized
ttcctgtcactccatcatgcca

SEQ ID NO: 1408547 - DNA, 22 bp, Artificial Sequence
  chemically synthesized
tcctgtcactccatcatgccaa

SEQ ID NO: 1408548 - DNA, 22 bp, Artificial Sequence
  chemically synthesized
cctgtcactccatcatgccaat

SEQ ID NO: 1408549 - DNA, 22 bp, Artificial Sequence
  chemically synthesized
ctgtcactccatcatgccaata

SEQ ID NO: 1408550 - DNA, 22 bp, Artificial Sequence
  chemically synthesized
cagcagccaacttattggcatg

SEQ ID NO: 1408551 - DNA, 22 bp, Artificial Sequence
  chemically synthesized
tcactccatcatgccaataagt

SEQ ID NO: 1408552 - DNA, 22 bp, Artificial Sequence
  chemically synthesized
ttacagcagccaacttattggc

SEQ ID NO: 1408553 - DNA, 22 bp, Artificial Sequence
  chemically synthesized
gttacagcagccaacttattgg

SEQ ID NO: 1408554 - DNA, 22 bp, Artificial Sequence
  chemically synthesized
atttgttacagcagccaactta

SEQ ID NO: 1408555 - DNA, 22 bp, Artificial Sequence
  chemically synthesized
catcatgccaataagttggctg

SEQ ID NO: 1408556 - DNA, 22 bp, Artificial Sequence
  chemically synthesized
gatttgttacagcagccaactt

SEQ ID NO: 1408557 - DNA, 22 bp, Artificial Sequence
  chemically synthesized
tcttgatttgttacagcagcca

SEQ ID NO: 1408558 - DNA, 22 bp, Artificial Sequence
  chemically synthesized
cactatcttgatttgttacagc

SEQ ID NO: 1408559 - DNA, 22 bp, Artificial Sequence
  chemically synthesized
gcactatcttgatttgttacag

SEQ ID NO: 1408560 - DNA, 22 bp, Artificial Sequence
  chemically synthesized
tgcactatcttgatttgttaca

SEQ ID NO: 1408561 - DNA, 22 bp, Artificial Sequence
  chemically synthesized
ttttgcactatcttgatttgtt

SEQ ID NO: 1408562 - DNA, 22 bp, Artificial Sequence
  chemically synthesized
gctgctgtaacaaatcaagata

SEQ ID NO: 1408563 - DNA, 22 bp, Artificial Sequence
  chemically synthesized
ctgtaacaaatcaagatagtgc

SEQ ID NO: 1408564 - DNA, 22 bp, Artificial Sequence
  chemically synthesized
taacaaatcaagatagtgcaaa

SEQ ID NO: 1408565 - DNA, 22 bp, Artificial Sequence
  chemically synthesized
aggaagatgacagaatcaggag

SEQ ID NO: 1408566 - DNA, 22 bp, Artificial Sequence
  chemically synthesized
caggaagatgacagaatcagga

SEQ ID NO: 1408567 - DNA, 22 bp, Artificial Sequence
  chemically synthesized
tcaggaagatgacagaatcagg

SEQ ID NO: 1408568 - DNA, 22 bp, Artificial Sequence
  chemically synthesized
tctcctgattctgtcatcttcc

SEQ ID NO: 1408569 - DNA, 22 bp, Artificial Sequence
  chemically synthesized
ctcctgattctgtcatcttcct

SEQ ID NO: 1408570 - DNA, 22 bp, Artificial Sequence
  chemically synthesized
tcctgattctgtcatcttcctg

SEQ ID NO: 1408571 - DNA, 22 bp, Artificial Sequence
  chemically synthesized
ctgattctgtcatcttcctgaa

SEQ ID NO: 1408572 - DNA, 22 bp, Artificial Sequence
  chemically synthesized
attctgtcatcttcctgaaagc

SEQ ID NO: 1408573 - DNA, 22 bp, Artificial Sequence
  chemically synthesized
tgtcatcttcctgaaagcattc

SEQ ID NO: 1408574 - DNA, 22 bp, Artificial Sequence
  chemically synthesized
tcatcttcctgaaagcattcta

SEQ ID NO: 1408575 - DNA, 22 bp, Artificial Sequence
  chemically synthesized
ccagcagtcggcagtaatagaa

SEQ ID NO: 1408576 - DNA, 22 bp, Artificial Sequence
  chemically synthesized
cctgaaagcattctattactgc

SEQ ID NO: 1408577 - DNA, 22 bp, Artificial Sequence
  chemically synthesized
ctgaaagcattctattactgcc

SEQ ID NO: 1408578 - DNA, 22 bp, Artificial Sequence
  chemically synthesized
gttcccagcagtcggcagtaat

SEQ ID NO: 1408579 - DNA, 22 bp, Artificial Sequence
  chemically synthesized
aaagcattctattactgccgac

SEQ ID NO: 1408580 - DNA, 22 bp, Artificial Sequence
  chemically synthesized
tggttcccagcagtcggcagta

SEQ ID NO: 1408581 - DNA, 22 bp, Artificial Sequence
  chemically synthesized
ctggttcccagcagtcggcagt

SEQ ID NO: 1408582 - DNA, 22 bp, Artificial Sequence
  chemically synthesized
tctggttcccagcagtcggcag

SEQ ID NO: 1408583 - DNA, 22 bp, Artificial Sequence
  chemically synthesized
tattactgccgactgctgggaa

SEQ ID NO: 1408584 - DNA, 22 bp, Artificial Sequence
  chemically synthesized
ttactgccgactgctgggaacc

SEQ ID NO: 1408585 - DNA, 22 bp, Artificial Sequence
  chemically synthesized
aaatagactttctggttcccag

SEQ ID NO: 1408586 - DNA, 22 bp, Artificial Sequence
  chemically synthesized
ctgccgactgctgggaaccaga

SEQ ID NO: 1408587 - DNA, 22 bp, Artificial Sequence
  chemically synthesized
ccgactgctgggaaccagaaag

SEQ ID NO: 1408588 - DNA, 22 bp, Artificial Sequence
  chemically synthesized
gaattcaaatagactttctggt

SEQ ID NO: 1408589 - DNA, 22 bp, Artificial Sequence
  chemically synthesized
ttggaattcaaatagactttct

SEQ ID NO: 1408590 - DNA, 22 bp, Artificial Sequence
  chemically synthesized
ctgggaaccagaaagtctattt

SEQ ID NO: 1408591 - DNA, 22 bp, Artificial Sequence
  chemically synthesized
ggaaccagaaagtctatttgaa

SEQ ID NO: 1408592 - DNA, 22 bp, Artificial Sequence
  chemically synthesized
aatcatgcgaaaggggagctgt

SEQ ID NO: 1408593 - DNA, 22 bp, Artificial Sequence
  chemically synthesized
tttgaattccaacagctcccct

SEQ ID NO: 1408594 - DNA, 22 bp, Artificial Sequence
  chemically synthesized
gaatcatgcgaaaggggagctg

SEQ ID NO: 1408595 - DNA, 22 bp, Artificial Sequence
  chemically synthesized
gaattccaacagctcccctttc

SEQ ID NO: 1408596 - DNA, 22 bp, Artificial Sequence
  chemically synthesized
aattccaacagctcccctttcg

SEQ ID NO: 1408597 - DNA, 22 bp, Artificial Sequence
  chemically synthesized
acttgaatcatgcgaaagggga

SEQ ID NO: 1408598 - DNA, 22 bp, Artificial Sequence
  chemically synthesized
caacagctcccctttcgcatga

SEQ ID NO: 1408599 - DNA, 22 bp, Artificial Sequence
  chemically synthesized
acctaacttgaatcatgcgaaa

SEQ ID NO: 1408600 - DNA, 22 bp, Artificial Sequence
  chemically synthesized
ccctttcgcatgattcaagtta

SEQ ID NO: 1408601 - DNA, 22 bp, Artificial Sequence
  chemically synthesized
tcgcatgattcaagttaggtta

SEQ ID NO: 1408602 - DNA, 22 bp, Artificial Sequence
  chemically synthesized
ggcatgcccacctaacctaact

SEQ ID NO: 1408603 - DNA, 22 bp, Artificial Sequence
  chemically synthesized
cgcatgattcaagttaggttag

SEQ ID NO: 1408604 - DNA, 22 bp, Artificial Sequence
  chemically synthesized
gcatgattcaagttaggttagg

SEQ ID NO: 1408605 - DNA, 22 bp, Artificial Sequence
  chemically synthesized
aagttaggttaggtgggcatgc

SEQ ID NO: 1408606 - DNA, 22 bp, Artificial Sequence
  chemically synthesized
aaagaatcatgttaggcatgcc

SEQ ID NO: 1408607 - DNA, 22 bp, Artificial Sequence
  chemically synthesized
ggttaggtgggcatgcctaaca

SEQ ID NO: 1408608 - DNA, 22 bp, Artificial Sequence
  chemically synthesized
ggtgggcatgcctaacatgatt

SEQ ID NO: 1408609 - DNA, 22 bp, Artificial Sequence
  chemically synthesized
cataataaatgactgaaagaat

SEQ ID NO: 1408610 - DNA, 22 bp, Artificial Sequence
  chemically synthesized
acatgattctttcagtcattta

SEQ ID NO: 1408611 - DNA, 22 bp, Artificial Sequence
  chemically synthesized
tagcagctgcataataaatgac

SEQ ID NO: 1408612 - DNA, 22 bp, Artificial Sequence
  chemically synthesized
tttcagtcatttattatgcagc

SEQ ID NO: 1408613 - DNA, 22 bp, Artificial Sequence
  chemically synthesized
tcagtcatttattatgcagctg

SEQ ID NO: 1408614 - DNA, 22 bp, Artificial Sequence
  chemically synthesized
cagtcatttattatgcagctgc

SEQ ID NO: 1408615 - DNA, 22 bp, Artificial Sequence
  chemically synthesized
agtcatttattatgcagctgct

SEQ ID NO: 1408616 - DNA, 22 bp, Artificial Sequence
  chemically synthesized
ccacaccgacgttgtagcagct

SEQ ID NO: 1408617 - DNA, 22 bp, Artificial Sequence
  chemically synthesized
attatgcagctgctacaacgtc

SEQ ID NO: 1408618 - DNA, 22 bp, Artificial Sequence
  chemically synthesized
ttatgcagctgctacaacgtcg

SEQ ID NO: 1408619 - DNA, 22 bp, Artificial Sequence
  chemically synthesized
tgcagctgctacaacgtcggtg

SEQ ID NO: 1408620 - DNA, 22 bp, Artificial Sequence
  chemically synthesized
ctacaacgtcggtgtggtaacc

SEQ ID NO: 1408621 - DNA, 22 bp, Artificial Sequence
  chemically synthesized
caacgtcggtgtggtaaccact

SEQ ID NO: 1408622 - DNA, 22 bp, Artificial Sequence
  chemically synthesized
acgtatcagatagtcagagtgg

SEQ ID NO: 1408623 - DNA, 22 bp, Artificial Sequence
  chemically synthesized
gactgacgtatcagatagtcag

SEQ ID NO: 1408624 - DNA, 22 bp, Artificial Sequence
  chemically synthesized
ttcgactgacgtatcagatagt

SEQ ID NO: 1408625 - DNA, 22 bp, Artificial Sequence
  chemically synthesized
gttcgactgacgtatcagatag

SEQ ID NO: 1408626 - DNA, 22 bp, Artificial Sequence
  chemically synthesized
tgttcgactgacgtatcagata

SEQ ID NO: 1408627 - DNA, 22 bp, Artificial Sequence
  chemically synthesized
tgactatctgatacgtcagtcg

SEQ ID NO: 1408628 - DNA, 22 bp, Artificial Sequence
  chemically synthesized
actatctgatacgtcagtcgaa

SEQ ID NO: 1408629 - DNA, 22 bp, Artificial Sequence
  chemically synthesized
tctgatacgtcagtcgaacaaa

SEQ ID NO: 1408630 - DNA, 22 bp, Artificial Sequence
  chemically synthesized
cgaggtataggttttgttcgac

SEQ ID NO: 1408631 - DNA, 22 bp, Artificial Sequence
  chemically synthesized
ctccgaggtataggttttgttc

SEQ ID NO: 1408632 - DNA, 22 bp, Artificial Sequence
  chemically synthesized
atacgtcagtcgaacaaaacct

SEQ ID NO: 1408633 - DNA, 22 bp, Artificial Sequence
  chemically synthesized
gctccgaggtataggttttgtt

SEQ ID NO: 1408634 - DNA, 22 bp, Artificial Sequence
  chemically synthesized
atgtgtttgctccgaggtatag

SEQ ID NO: 1408635 - DNA, 22 bp, Artificial Sequence
  chemically synthesized
gctcatgtgtttgctccgaggt

SEQ ID NO: 1408636 - DNA, 22 bp, Artificial Sequence
  chemically synthesized
tggctcatgtgtttgctccgag

SEQ ID NO: 1408637 - DNA, 22 bp, Artificial Sequence
  chemically synthesized
ctctggctcatgtgtttgctcc

SEQ ID NO: 1408638 - DNA, 22 bp, Artificial Sequence
  chemically synthesized
tacctcggagcaaacacatgag

SEQ ID NO: 1408639 - DNA, 22 bp, Artificial Sequence
  chemically synthesized
ggagcaaacacatgagccagag

SEQ ID NO: 1408640 - DNA, 22 bp, Artificial Sequence
  chemically synthesized
aatgcaaacgctgctctggctc

SEQ ID NO: 1408641 - DNA, 22 bp, Artificial Sequence
  chemically synthesized
gttaaatgcaaacgctgctctg

SEQ ID NO: 1408642 - DNA, 22 bp, Artificial Sequence
  chemically synthesized
ggcaggaagaatgctcgttaaa

SEQ ID NO: 1408643 - DNA, 22 bp, Artificial Sequence
  chemically synthesized
aggcaggaagaatgctcgttaa

SEQ ID NO: 1408644 - DNA, 22 bp, Artificial Sequence
  chemically synthesized
taggcaggaagaatgctcgtta

SEQ ID NO: 1408645 - DNA, 22 bp, Artificial Sequence
  chemically synthesized
ttaggcaggaagaatgctcgtt

SEQ ID NO: 1408646 - DNA, 22 bp, Artificial Sequence
  chemically synthesized
tttaggcaggaagaatgctcgt

SEQ ID NO: 1408647 - DNA, 22 bp, Artificial Sequence
  chemically synthesized
ttttttaggcaggaagaatgct

SEQ ID NO: 1408648 - DNA, 22 bp, Artificial Sequence
  chemically synthesized
gcatttaacgagcattcttcct

SEQ ID NO: 1408649 - DNA, 22 bp, Artificial Sequence
  chemically synthesized
catttaacgagcattcttcctg

SEQ ID NO: 1408650 - DNA, 22 bp, Artificial Sequence
  chemically synthesized
aacgagcattcttcctgcctaa

SEQ ID NO: 1408651 - DNA, 22 bp, Artificial Sequence
  chemically synthesized
acgagcattcttcctgcctaaa

SEQ ID NO: 1408652 - DNA, 22 bp, Artificial Sequence
  chemically synthesized
cagatccactgttttttaggca

SEQ ID NO: 1408653 - DNA, 22 bp, Artificial Sequence
  chemically synthesized
gcagatccactgttttttaggc

SEQ ID NO: 1408654 - DNA, 22 bp, Artificial Sequence
  chemically synthesized
ttcctgcctaaaaaacagtgga

SEQ ID NO: 1408655 - DNA, 22 bp, Artificial Sequence
  chemically synthesized
cctgcctaaaaaacagtggatc

SEQ ID NO: 1408656 - DNA, 22 bp, Artificial Sequence
  chemically synthesized
ctgcctaaaaaacagtggatct

SEQ ID NO: 1408657 - DNA, 22 bp, Artificial Sequence
  chemically synthesized
aaagagatttgcagatccactg

SEQ ID NO: 1408658 - DNA, 22 bp, Artificial Sequence
  chemically synthesized
cctaaaaaacagtggatctgca

SEQ ID NO: 1408659 - DNA, 22 bp, Artificial Sequence
  chemically synthesized
aaaaacagtggatctgcaaatc

SEQ ID NO: 1408660 - DNA, 22 bp, Artificial Sequence
  chemically synthesized
caaatctctttcagtatctact

SEQ ID NO: 1408661 - DNA, 22 bp, Artificial Sequence
  chemically synthesized
tacagaagagcgagtagatact

SEQ ID NO: 1408662 - DNA, 22 bp, Artificial Sequence
  chemically synthesized
catctgtacagaagagcgagta

SEQ ID NO: 1408663 - DNA, 22 bp, Artificial Sequence
  chemically synthesized
gcatctgtacagaagagcgagt

SEQ ID NO: 1408664 - DNA, 22 bp, Artificial Sequence
  chemically synthesized
tttcagtatctactcgctcttc

SEQ ID NO: 1408665 - DNA, 22 bp, Artificial Sequence
  chemically synthesized
tgcatctgtacagaagagcgag

SEQ ID NO: 1408666 - DNA, 22 bp, Artificial Sequence
  chemically synthesized
tcagtatctactcgctcttctg

SEQ ID NO: 1408667 - DNA, 22 bp, Artificial Sequence
  chemically synthesized
cagtatctactcgctcttctgt

SEQ ID NO: 1408668 - DNA, 22 bp, Artificial Sequence
  chemically synthesized
agtatctactcgctcttctgta

SEQ ID NO: 1408669 - DNA, 22 bp, Artificial Sequence
  chemically synthesized
ctcgctcttctgtacagatgca

SEQ ID NO: 1408670 - DNA, 22 bp, Artificial Sequence
  chemically synthesized
atccaaaggctttgcatctgta

SEQ ID NO: 1408671 - DNA, 22 bp, Artificial Sequence
  chemically synthesized
gctcttctgtacagatgcaaag

SEQ ID NO: 1408672 - DNA, 22 bp, Artificial Sequence
  chemically synthesized
ttctgtacagatgcaaagcctt

SEQ ID NO: 1408673 - DNA, 22 bp, Artificial Sequence
  chemically synthesized
ctgtacagatgcaaagcctttg

SEQ ID NO: 1408674 - DNA, 22 bp, Artificial Sequence
  chemically synthesized
tgtacagatgcaaagcctttgg

SEQ ID NO: 1408675 - DNA, 22 bp, Artificial Sequence
  chemically synthesized
tacagatgcaaagcctttggat

SEQ ID NO: 1408676 - DNA, 22 bp, Artificial Sequence
  chemically synthesized
ggaaaataatctaatccaaagg

SEQ ID NO: 1408677 - DNA, 22 bp, Artificial Sequence
  chemically synthesized
aggaaaataatctaatccaaag

SEQ ID NO: 1408678 - DNA, 22 bp, Artificial Sequence
  chemically synthesized
cacttaggaaaataatctaatc

SEQ ID NO: 1408679 - DNA, 22 bp, Artificial Sequence
  chemically synthesized
ttacacttaggaaaataatcta

SEQ ID NO: 1408680 - DNA, 22 bp, Artificial Sequence
  chemically synthesized
ttgttacacttaggaaaataat

SEQ ID NO: 1408681 - DNA, 22 bp, Artificial Sequence
  chemically synthesized
ctattgttacacttaggaaaat

SEQ ID NO: 1408682 - DNA, 22 bp, Artificial Sequence
  chemically synthesized
tggattagattattttcctaag

SEQ ID NO: 1408683 - DNA, 22 bp, Artificial Sequence
  chemically synthesized
ggattagattattttcctaagt

SEQ ID NO: 1408684 - DNA, 22 bp, Artificial Sequence
  chemically synthesized
tactattgttacacttaggaaa

SEQ ID NO: 1408685 - DNA, 22 bp, Artificial Sequence
  chemically synthesized
gattagattattttcctaagtg

SEQ ID NO: 1408686 - DNA, 22 bp, Artificial Sequence
  chemically synthesized
gattattttcctaagtgtaaca

SEQ ID NO: 1408687 - DNA, 22 bp, Artificial Sequence
  chemically synthesized
ttttcctaagtgtaacaatagt

SEQ ID NO: 1408688 - DNA, 22 bp, Artificial Sequence
  chemically synthesized
gcgaggaactctactattgtta

SEQ ID NO: 1408689 - DNA, 22 bp, Artificial Sequence
  chemically synthesized
ggcgaggaactctactattgtt

SEQ ID NO: 1408690 - DNA, 22 bp, Artificial Sequence
  chemically synthesized
tcctaagtgtaacaatagtaga

SEQ ID NO: 1408691 - DNA, 22 bp, Artificial Sequence
  chemically synthesized
cctaagtgtaacaatagtagag

SEQ ID NO: 1408692 - DNA, 22 bp, Artificial Sequence
  chemically synthesized
ctaagtgtaacaatagtagagt

SEQ ID NO: 1408693 - DNA, 22 bp, Artificial Sequence
  chemically synthesized
agtgtaacaatagtagagttcc

SEQ ID NO: 1408694 - DNA, 22 bp, Artificial Sequence
  chemically synthesized
agtgtgaataatatgatgtttg

SEQ ID NO: 1408695 - DNA, 22 bp, Artificial Sequence
  chemically synthesized
cagtgtgaataatatgatgttt

SEQ ID NO: 1408696 - DNA, 22 bp, Artificial Sequence
  chemically synthesized
ctcgccaaacatcatattattc

SEQ ID NO: 1408697 - DNA, 22 bp, Artificial Sequence
  chemically synthesized
gccaaacatcatattattcaca

SEQ ID NO: 1408698 - DNA, 22 bp, Artificial Sequence
  chemically synthesized
ttcacactgaaattttggctga

SEQ ID NO: 1408699 - DNA, 22 bp, Artificial Sequence
  chemically synthesized
acactgaaattttggctgattt

SEQ ID NO: 1408700 - DNA, 22 bp, Artificial Sequence
  chemically synthesized
tgaagataagtaaaaatcagcc

SEQ ID NO: 1408701 - DNA, 22 bp, Artificial Sequence
  chemically synthesized
aaattttggctgatttttactt

SEQ ID NO: 1408702 - DNA, 22 bp, Artificial Sequence
  chemically synthesized
aaaggctgtgaagataagtaaa

SEQ ID NO: 1408703 - DNA, 22 bp, Artificial Sequence
  chemically synthesized
aaaaggctgtgaagataagtaa

SEQ ID NO: 1408704 - DNA, 22 bp, Artificial Sequence
  chemically synthesized
tggctgatttttacttatcttc

SEQ ID NO: 1408705 - DNA, 22 bp, Artificial Sequence
  chemically synthesized
ggctgatttttacttatcttca

SEQ ID NO: 1408706 - DNA, 22 bp, Artificial Sequence
  chemically synthesized
gctgatttttacttatcttcac

SEQ ID NO: 1408707 - DNA, 22 bp, Artificial Sequence
  chemically synthesized
cccttaaaaggctgtgaagata

SEQ ID NO: 1408708 - DNA, 22 bp, Artificial Sequence
  chemically synthesized
acccttaaaaggctgtgaagat

SEQ ID NO: 1408709 - DNA, 22 bp, Artificial Sequence
  chemically synthesized
tacccttaaaaggctgtgaaga

SEQ ID NO: 1408710 - DNA, 22 bp, Artificial Sequence
  chemically synthesized
atttttacttatcttcacagcc

SEQ ID NO: 1408711 - DNA, 22 bp, Artificial Sequence
  chemically synthesized
ttacccttaaaaggctgtgaag

SEQ ID NO: 1408712 - DNA, 22 bp, Artificial Sequence
  chemically synthesized
ttacttatcttcacagcctttt

SEQ ID NO: 1408713 - DNA, 22 bp, Artificial Sequence
  chemically synthesized
tacttatcttcacagcctttta

SEQ ID NO: 1408714 - DNA, 22 bp, Artificial Sequence
  chemically synthesized
acttatcttcacagccttttaa

SEQ ID NO: 1408715 - DNA, 22 bp, Artificial Sequence
  chemically synthesized
cttatcttcacagccttttaag

SEQ ID NO: 1408716 - DNA, 22 bp, Artificial Sequence
  chemically synthesized
atcttcacagccttttaagggt

SEQ ID NO: 1408717 - DNA, 22 bp, Artificial Sequence
  chemically synthesized
tcttcacagccttttaagggta

SEQ ID NO: 1408718 - DNA, 22 bp, Artificial Sequence
  chemically synthesized
agaagagagtttttacccttaa

SEQ ID NO: 1408719 - DNA, 22 bp, Artificial Sequence
  chemically synthesized
cacagccttttaagggtaaaaa

SEQ ID NO: 1408720 - DNA, 22 bp, Artificial Sequence
  chemically synthesized
acagccttttaagggtaaaaac

SEQ ID NO: 1408721 - DNA, 22 bp, Artificial Sequence
  chemically synthesized
ttaagggtaaaaactctcttct

SEQ ID NO: 1408722 - DNA, 22 bp, Artificial Sequence
  chemically synthesized
taagggtaaaaactctcttctg

SEQ ID NO: 1408723 - DNA, 22 bp, Artificial Sequence
  chemically synthesized
aagggtaaaaactctcttctga

SEQ ID NO: 1408724 - DNA, 22 bp, Artificial Sequence
  chemically synthesized
caaaagtacaattcagaagaga

SEQ ID NO: 1408725 - DNA, 22 bp, Artificial Sequence
  chemically synthesized
agggtaaaaactctcttctgaa

SEQ ID NO: 1408726 - DNA, 22 bp, Artificial Sequence
  chemically synthesized
ttgcaaaagtacaattcagaag

SEQ ID NO: 1408727 - DNA, 22 bp, Artificial Sequence
  chemically synthesized
attgcaaaagtacaattcagaa

SEQ ID NO: 1408728 - DNA, 22 bp, Artificial Sequence
  chemically synthesized
tcttctgaattgtacttttgca

SEQ ID NO: 1408729 - DNA, 22 bp, Artificial Sequence
  chemically synthesized
ttctgaattgtacttttgcaat

SEQ ID NO: 1408730 - DNA, 22 bp, Artificial Sequence
  chemically synthesized
ctgaattgtacttttgcaataa

SEQ ID NO: 1408731 - DNA, 22 bp, Artificial Sequence
  chemically synthesized
tgaattgtacttttgcaataag

SEQ ID NO: 1408732 - DNA, 22 bp, Artificial Sequence
  chemically synthesized
agcacacaacatcttattgcaa

SEQ ID NO: 1408733 - DNA, 22 bp, Artificial Sequence
  chemically synthesized
aattgtacttttgcaataagat

SEQ ID NO: 1408734 - DNA, 22 bp, Artificial Sequence
  chemically synthesized
tacttttgcaataagatgttgt

SEQ ID NO: 1408735 - DNA, 22 bp, Artificial Sequence
  chemically synthesized
ttgcaataagatgttgtgtgct

SEQ ID NO: 1408736 - DNA, 22 bp, Artificial Sequence
  chemically synthesized
tgcaataagatgttgtgtgctc

SEQ ID NO: 1408737 - DNA, 22 bp, Artificial Sequence
  chemically synthesized
gcaataagatgttgtgtgctca

SEQ ID NO: 1408738 - DNA, 22 bp, Artificial Sequence
  chemically synthesized
caataagatgttgtgtgctcag

SEQ ID NO: 1408739 - DNA, 22 bp, Artificial Sequence
  chemically synthesized
caacgcagaaatgtggagctga

SEQ ID NO: 1408740 - DNA, 22 bp, Artificial Sequence
  chemically synthesized
acaacgcagaaatgtggagctg

SEQ ID NO: 1408741 - DNA, 22 bp, Artificial Sequence
  chemically synthesized
tacaacgcagaaatgtggagct

SEQ ID NO: 1408742 - DNA, 22 bp, Artificial Sequence
  chemically synthesized
tgtgctcagctccacatttctg

SEQ ID NO: 1408743 - DNA, 22 bp, Artificial Sequence
  chemically synthesized
tattttacaacgcagaaatgtg

SEQ ID NO: 1408744 - DNA, 22 bp, Artificial Sequence
  chemically synthesized
agctccacatttctgcgttgta

SEQ ID NO: 1408745 - DNA, 22 bp, Artificial Sequence
  chemically synthesized
cacatttctgcgttgtaaaata

SEQ ID NO: 1408746 - DNA, 22 bp, Artificial Sequence
  chemically synthesized
agaaagtgcatgctatatttta

SEQ ID NO: 1408747 - DNA, 22 bp, Artificial Sequence
  chemically synthesized
gagaaagtgcatgctatatttt

SEQ ID NO: 1408748 - DNA, 22 bp, Artificial Sequence
  chemically synthesized
ctgcgttgtaaaatatagcatg

SEQ ID NO: 1408749 - DNA, 22 bp, Artificial Sequence
  chemically synthesized
tgcgttgtaaaatatagcatgc

SEQ ID NO: 1408750 - DNA, 22 bp, Artificial Sequence
  chemically synthesized
catttgagaaagtgcatgctat

SEQ ID NO: 1408751 - DNA, 22 bp, Artificial Sequence
  chemically synthesized
cgttgtaaaatatagcatgcac

SEQ ID NO: 1408752 - DNA, 22 bp, Artificial Sequence
  chemically synthesized
taaaatatagcatgcactttct

SEQ ID NO: 1408753 - DNA, 22 bp, Artificial Sequence
  chemically synthesized
tagagtcacaagaggcaaattc

SEQ ID NO: 1408754 - DNA, 22 bp, Artificial Sequence
  chemically synthesized
tctcaaatggaatttgcctctt

SEQ ID NO: 1408755 - DNA, 22 bp, Artificial Sequence
  chemically synthesized
ctatagagtcacaagaggcaaa

SEQ ID NO: 1408756 - DNA, 22 bp, Artificial Sequence
  chemically synthesized
ctcaaatggaatttgcctcttg

SEQ ID NO: 1408757 - DNA, 22 bp, Artificial Sequence
  chemically synthesized
gctatagagtcacaagaggcaa

SEQ ID NO: 1408758 - DNA, 22 bp, Artificial Sequence
  chemically synthesized
tcaaatggaatttgcctcttgt

SEQ ID NO: 1408759 - DNA, 22 bp, Artificial Sequence
  chemically synthesized
aaatggaatttgcctcttgtga

SEQ ID NO: 1408760 - DNA, 22 bp, Artificial Sequence
  chemically synthesized
aaaatttgctatagagtcacaa

SEQ ID NO: 1408761 - DNA, 22 bp, Artificial Sequence
  chemically synthesized
gaaaatttgctatagagtcaca

SEQ ID NO: 1408762 - DNA, 22 bp, Artificial Sequence
  chemically synthesized
tttgaaaatttgctatagagtc

SEQ ID NO: 1408763 - DNA, 22 bp, Artificial Sequence
  chemically synthesized
atttgaaaatttgctatagagt

SEQ ID NO: 1408764 - DNA, 22 bp, Artificial Sequence
  chemically synthesized
gcctcttgtgactctatagcaa

SEQ ID NO: 1408765 - DNA, 22 bp, Artificial Sequence
  chemically synthesized
ttatttgaaaatttgctataga

SEQ ID NO: 1408766 - DNA, 22 bp, Artificial Sequence
  chemically synthesized
cctcttgtgactctatagcaaa

SEQ ID NO: 1408767 - DNA, 22 bp, Artificial Sequence
  chemically synthesized
ttgtgactctatagcaaatttt

SEQ ID NO: 1408768 - DNA, 22 bp, Artificial Sequence
  chemically synthesized
gtgactctatagcaaattttca

SEQ ID NO: 1408769 - DNA, 22 bp, Artificial Sequence
  chemically synthesized
tgactctatagcaaattttcaa

SEQ ID NO: 1408770 - DNA, 22 bp, Artificial Sequence
  chemically synthesized
aaatatcctcttatttgaaaat

SEQ ID NO: 1408771 - DNA, 22 bp, Artificial Sequence
  chemically synthesized
gaaatatcctcttatttgaaaa

SEQ ID NO: 1408772 - DNA, 22 bp, Artificial Sequence
  chemically synthesized
ttgaaatatcctcttatttgaa

SEQ ID NO: 1408773 - DNA, 22 bp, Artificial Sequence
  chemically synthesized
tatagcaaattttcaaataaga

SEQ ID NO: 1408774 - DNA, 22 bp, Artificial Sequence
  chemically synthesized
cttgaaatatcctcttatttga

SEQ ID NO: 1408775 - DNA, 22 bp, Artificial Sequence
  chemically synthesized
tcttgaaatatcctcttatttg

SEQ ID NO: 1408776 - DNA, 22 bp, Artificial Sequence
  chemically synthesized
tagcaaattttcaaataagagg

SEQ ID NO: 1408777 - DNA, 22 bp, Artificial Sequence
  chemically synthesized
tcaaataagaggatatttcaag

SEQ ID NO: 1408778 - DNA, 22 bp, Artificial Sequence
  chemically synthesized
caaataagaggatatttcaaga

SEQ ID NO: 1408779 - DNA, 22 bp, Artificial Sequence
  chemically synthesized
aaataagaggatatttcaagaa

SEQ ID NO: 1408780 - DNA, 22 bp, Artificial Sequence
  chemically synthesized
cagtgtgcaaaataaataatat

SEQ ID NO: 1408781 - DNA, 22 bp, Artificial Sequence
  chemically synthesized
caagaaaatattatttattttg

SEQ ID NO: 1408782 - DNA, 22 bp, Artificial Sequence
  chemically synthesized
aagaaaatattatttattttgc

SEQ ID NO: 1408783 - DNA, 22 bp, Artificial Sequence
  chemically synthesized
aatatctccagtgtgcaaaata

SEQ ID NO: 1408784 - DNA, 22 bp, Artificial Sequence
  chemically synthesized
aaatatctccagtgtgcaaaat

SEQ ID NO: 1408785 - DNA, 22 bp, Artificial Sequence
  chemically synthesized
taaatatctccagtgtgcaaaa

SEQ ID NO: 1408786 - DNA, 22 bp, Artificial Sequence
  chemically synthesized
tttattttgcacactggagata

SEQ ID NO: 1408787 - DNA, 22 bp, Artificial Sequence
  chemically synthesized
attttgcacactggagatattt

SEQ ID NO: 1408788 - DNA, 22 bp, Artificial Sequence
  chemically synthesized
ttttgcacactggagatattta

SEQ ID NO: 1408789 - DNA, 22 bp, Artificial Sequence
  chemically synthesized
tgcacactggagatatttaaag

SEQ ID NO: 1408790 - DNA, 22 bp, Artificial Sequence
  chemically synthesized
gcacactggagatatttaaagt

SEQ ID NO: 1408791 - DNA, 22 bp, Artificial Sequence
  chemically synthesized
cacactggagatatttaaagtc

SEQ ID NO: 1408792 - DNA, 22 bp, Artificial Sequence
  chemically synthesized
gagatatttaaagtctggcacc

SEQ ID NO: 1408793 - DNA, 22 bp, Artificial Sequence
  chemically synthesized
ggagaagcatacagggtgccag

SEQ ID NO: 1408794 - DNA, 22 bp, Artificial Sequence
  chemically synthesized
gggagaagcatacagggtgcca

SEQ ID NO: 1408795 - DNA, 22 bp, Artificial Sequence
  chemically synthesized
cccttgggagaagcatacaggg

SEQ ID NO: 1408796 - DNA, 22 bp, Artificial Sequence
  chemically synthesized
aaagtctggcaccctgtatgct

SEQ ID NO: 1408797 - DNA, 22 bp, Artificial Sequence
  chemically synthesized
aagtctggcaccctgtatgctt

SEQ ID NO: 1408798 - DNA, 22 bp, Artificial Sequence
  chemically synthesized
gcaccctgtatgcttctcccaa

SEQ ID NO: 1408799 - DNA, 22 bp, Artificial Sequence
  chemically synthesized
tatgcttctcccaagggtagac

SEQ ID NO: 1408800 - DNA, 22 bp, Artificial Sequence
  chemically synthesized
ctcccaagggtagactttatac

SEQ ID NO: 1408801 - DNA, 22 bp, Artificial Sequence
  chemically synthesized
tcccaagggtagactttatact

SEQ ID NO: 1408802 - DNA, 22 bp, Artificial Sequence
  chemically synthesized
ccaagggtagactttatacttg

SEQ ID NO: 1408803 - DNA, 22 bp, Artificial Sequence
  chemically synthesized
aagtcaaaatatcaagtataaa

SEQ ID NO: 1408804 - DNA, 22 bp, Artificial Sequence
  chemically synthesized
atctaaagtcaaaatatcaagt

SEQ ID NO: 1408805 - DNA, 22 bp, Artificial Sequence
  chemically synthesized
tatacttgatattttgacttta

SEQ ID NO: 1408806 - DNA, 22 bp, Artificial Sequence
  chemically synthesized
atacttgatattttgactttag

SEQ ID NO: 1408807 - DNA, 22 bp, Artificial Sequence
  chemically synthesized
tacttgatattttgactttaga

SEQ ID NO: 1408808 - DNA, 22 bp, Artificial Sequence
  chemically synthesized
tgaagaaatcactcatctaaag

SEQ ID NO: 1408809 - DNA, 22 bp, Artificial Sequence
  chemically synthesized
gtgaagaaatcactcatctaaa

SEQ ID NO: 1408810 - DNA, 22 bp, Artificial Sequence
  chemically synthesized
gatattttgactttagatgagt

SEQ ID NO: 1408811 - DNA, 22 bp, Artificial Sequence
  chemically synthesized
tgtgaagaaatcactcatctaa

SEQ ID NO: 1408812 - DNA, 22 bp, Artificial Sequence
  chemically synthesized
atattttgactttagatgagtg

SEQ ID NO: 1408813 - DNA, 22 bp, Artificial Sequence
  chemically synthesized
ctttgtgaagaaatcactcatc

SEQ ID NO: 1408814 - DNA, 22 bp, Artificial Sequence
  chemically synthesized
actttgtgaagaaatcactcat

SEQ ID NO: 1408815 - DNA, 22 bp, Artificial Sequence
  chemically synthesized
ttactttgtgaagaaatcactc

SEQ ID NO: 1408816 - DNA, 22 bp, Artificial Sequence
  chemically synthesized
tgactttagatgagtgatttct

SEQ ID NO: 1408817 - DNA, 22 bp, Artificial Sequence
  chemically synthesized
cttactttgtgaagaaatcact

SEQ ID NO: 1408818 - DNA, 22 bp, Artificial Sequence
  chemically synthesized
gactttagatgagtgatttctt

SEQ ID NO: 1408819 - DNA, 22 bp, Artificial Sequence
  chemically synthesized
actttagatgagtgatttcttc

SEQ ID NO: 1408820 - DNA, 22 bp, Artificial Sequence
  chemically synthesized
atttcttactttgtgaagaaat

SEQ ID NO: 1408821 - DNA, 22 bp, Artificial Sequence
  chemically synthesized
tagatgagtgatttcttcacaa

SEQ ID NO: 1408822 - DNA, 22 bp, Artificial Sequence
  chemically synthesized
agatgagtgatttcttcacaaa

SEQ ID NO: 1408823 - DNA, 22 bp, Artificial Sequence
  chemically synthesized
gatgagtgatttcttcacaaag

SEQ ID NO: 1408824 - DNA, 22 bp, Artificial Sequence
  chemically synthesized
atctaatttcttactttgtgaa

SEQ ID NO: 1408825 - DNA, 22 bp, Artificial Sequence
  chemically synthesized
agctaatctaatttcttacttt

SEQ ID NO: 1408826 - DNA, 22 bp, Artificial Sequence
  chemically synthesized
cttcacaaagtaagaaattaga

SEQ ID NO: 1408827 - DNA, 22 bp, Artificial Sequence
  chemically synthesized
ttcacaaagtaagaaattagat

SEQ ID NO: 1408828 - DNA, 22 bp, Artificial Sequence
  chemically synthesized
cacaaagtaagaaattagatta

SEQ ID NO: 1408829 - DNA, 22 bp, Artificial Sequence
  chemically synthesized
acaaagtaagaaattagattag

SEQ ID NO: 1408830 - DNA, 22 bp, Artificial Sequence
  chemically synthesized
tgtaagagattcagctaatcta

SEQ ID NO: 1408831 - DNA, 22 bp, Artificial Sequence
  chemically synthesized
aagaagttgtgtaagagattca

SEQ ID NO: 1408832 - DNA, 22 bp, Artificial Sequence
  chemically synthesized
ttaaagaagttgtgtaagagat

SEQ ID NO: 1408833 - DNA, 22 bp, Artificial Sequence
  chemically synthesized
gttaaagaagttgtgtaagaga

SEQ ID NO: 1408834 - DNA, 22 bp, Artificial Sequence
  chemically synthesized
gattagctgaatctcttacaca

SEQ ID NO: 1408835 - DNA, 22 bp, Artificial Sequence
  chemically synthesized
cttgttaaagaagttgtgtaag

SEQ ID NO: 1408836 - DNA, 22 bp, Artificial Sequence
  chemically synthesized
acttgttaaagaagttgtgtaa

SEQ ID NO: 1408837 - DNA, 22 bp, Artificial Sequence
  chemically synthesized
gctgaatctcttacacaacttc

SEQ ID NO: 1408838 - DNA, 22 bp, Artificial Sequence
  chemically synthesized
tttacttgttaaagaagttgtg

SEQ ID NO: 1408839 - DNA, 22 bp, Artificial Sequence
  chemically synthesized
atttacttgttaaagaagttgt

SEQ ID NO: 1408840 - DNA, 22 bp, Artificial Sequence
  chemically synthesized
aatctcttacacaacttcttta

SEQ ID NO: 1408841 - DNA, 22 bp, Artificial Sequence
  chemically synthesized
ttacacaacttctttaacaagt

SEQ ID NO: 1408842 - DNA, 22 bp, Artificial Sequence
  chemically synthesized
acacaacttctttaacaagtaa

SEQ ID NO: 1408843 - DNA, 22 bp, Artificial Sequence
  chemically synthesized
aatagcatttatttacttgtta

SEQ ID NO: 1408844 - DNA, 22 bp, Artificial Sequence
  chemically synthesized
cacaacttctttaacaagtaaa

SEQ ID NO: 1408845 - DNA, 22 bp, Artificial Sequence
  chemically synthesized
ctgaatagcatttatttacttg

SEQ ID NO: 1408846 - DNA, 22 bp, Artificial Sequence
  chemically synthesized
cctgaatagcatttatttactt

SEQ ID NO: 1408847 - DNA, 22 bp, Artificial Sequence
  chemically synthesized
tcctgaatagcatttatttact

SEQ ID NO: 1408848 - DNA, 22 bp, Artificial Sequence
  chemically synthesized
ctttaacaagtaaataaatgct

SEQ ID NO: 1408849 - DNA, 22 bp, Artificial Sequence
  chemically synthesized
tttaacaagtaaataaatgcta

SEQ ID NO: 1408850 - DNA, 22 bp, Artificial Sequence
  chemically synthesized
taacaagtaaataaatgctatt

SEQ ID NO: 1408851 - DNA, 22 bp, Artificial Sequence
  chemically synthesized
aacaagtaaataaatgctattc

SEQ ID NO: 1408852 - DNA, 22 bp, Artificial Sequence
  chemically synthesized
acaagtaaataaatgctattca

SEQ ID NO: 1408853 - DNA, 22 bp, Artificial Sequence
  chemically synthesized
aaatacaaaatgcattttcctg

SEQ ID NO: 1408854 - DNA, 22 bp, Artificial Sequence
  chemically synthesized
aaaatacaaaatgcattttcct

SEQ ID NO: 1408855 - DNA, 22 bp, Artificial Sequence
  chemically synthesized
taaaatacaaaatgcattttcc

SEQ ID NO: 1408856 - DNA, 22 bp, Artificial Sequence
  chemically synthesized
ttaaaatacaaaatgcattttc

SEQ ID NO: 1408857 - DNA, 22 bp, Artificial Sequence
  chemically synthesized
gtatttttaaaatacaaaatgc

SEQ ID NO: 1408858 - DNA, 22 bp, Artificial Sequence
  chemically synthesized
ttcaggaaaatgcattttgtat

SEQ ID NO: 1408859 - DNA, 22 bp, Artificial Sequence
  chemically synthesized
aggaaaatgcattttgtatttt

SEQ ID NO: 1408860 - DNA, 22 bp, Artificial Sequence
  chemically synthesized
acgattagtatttttaaaatac

SEQ ID NO: 1408861 - DNA, 22 bp, Artificial Sequence
  chemically synthesized
attcacgattagtatttttaaa

SEQ ID NO: 1408862 - DNA, 22 bp, Artificial Sequence
  chemically synthesized
tgtattttaaaaatactaatcg

SEQ ID NO: 1408863 - DNA, 22 bp, Artificial Sequence
  chemically synthesized
gtattttaaaaatactaatcgt

SEQ ID NO: 1408864 - DNA, 22 bp, Artificial Sequence
  chemically synthesized
tattttaaaaatactaatcgtg

SEQ ID NO: 1408865 - DNA, 22 bp, Artificial Sequence
  chemically synthesized
acaaatactgattcacgattag

SEQ ID NO: 1408866 - DNA, 22 bp, Artificial Sequence
  chemically synthesized
aacaaatactgattcacgatta

SEQ ID NO: 1408867 - DNA, 22 bp, Artificial Sequence
  chemically synthesized
taacaaatactgattcacgatt

SEQ ID NO: 1408868 - DNA, 22 bp, Artificial Sequence
  chemically synthesized
ttaacaaatactgattcacgat

SEQ ID NO: 1408869 - DNA, 22 bp, Artificial Sequence
  chemically synthesized
taaaaatactaatcgtgaatca

SEQ ID NO: 1408870 - DNA, 22 bp, Artificial Sequence
  chemically synthesized
aaaaatactaatcgtgaatcag

SEQ ID NO: 1408871 - DNA, 22 bp, Artificial Sequence
  chemically synthesized
ttttaacaaatactgattcacg

SEQ ID NO: 1408872 - DNA, 22 bp, Artificial Sequence
  chemically synthesized
aaaatactaatcgtgaatcagt

SEQ ID NO: 1408873 - DNA, 22 bp, Artificial Sequence
  chemically synthesized
cttttaacaaatactgattcac

SEQ ID NO: 1408874 - DNA, 22 bp, Artificial Sequence
  chemically synthesized
cagtttcttttaacaaatactg

SEQ ID NO: 1408875 - DNA, 22 bp, Artificial Sequence
  chemically synthesized
atcgtgaatcagtatttgttaa

SEQ ID NO: 1408876 - DNA, 22 bp, Artificial Sequence
  chemically synthesized
ataacaattacagtttctttta

SEQ ID NO: 1408877 - DNA, 22 bp, Artificial Sequence
  chemically synthesized
gttaaaagaaactgtaattgtt

SEQ ID NO: 1408878 - DNA, 22 bp, Artificial Sequence
  chemically synthesized
ttaaaagaaactgtaattgtta

SEQ ID NO: 1408879 - DNA, 22 bp, Artificial Sequence
  chemically synthesized
tacggtataattgataacaatt

SEQ ID NO: 1408880 - DNA, 22 bp, Artificial Sequence
  chemically synthesized
aaagaaactgtaattgttatca

SEQ ID NO: 1408881 - DNA, 22 bp, Artificial Sequence
  chemically synthesized
gagaaaattatacggtataatt

SEQ ID NO: 1408882 - DNA, 22 bp, Artificial Sequence
  chemically synthesized
taattgttatcaattataccgt

SEQ ID NO: 1408883 - DNA, 22 bp, Artificial Sequence
  chemically synthesized
agagaaaattatacggtataat

SEQ ID NO: 1408884 - DNA, 22 bp, Artificial Sequence
  chemically synthesized
tagagaaaattatacggtataa

SEQ ID NO: 1408885 - DNA, 22 bp, Artificial Sequence
  chemically synthesized
ttatcaattataccgtataatt

SEQ ID NO: 1408886 - DNA, 22 bp, Artificial Sequence
  chemically synthesized
gaagttttagagaaaattatac

SEQ ID NO: 1408887 - DNA, 22 bp, Artificial Sequence
  chemically synthesized
tcaattataccgtataattttc

SEQ ID NO: 1408888 - DNA, 22 bp, Artificial Sequence
  chemically synthesized
ggaagttttagagaaaattata

SEQ ID NO: 1408889 - DNA, 22 bp, Artificial Sequence
  chemically synthesized
taccgtataattttctctaaaa

SEQ ID NO: 1408890 - DNA, 22 bp, Artificial Sequence
  chemically synthesized
tctctaaaacttccaagtttgc

SEQ ID NO: 1408891 - DNA, 22 bp, Artificial Sequence
  chemically synthesized
ctctaaaacttccaagtttgcc

SEQ ID NO: 1408892 - DNA, 22 bp, Artificial Sequence
  chemically synthesized
tctaaaacttccaagtttgcct

SEQ ID NO: 1408893 - DNA, 22 bp, Artificial Sequence
  chemically synthesized
taaaacttccaagtttgcctgt

SEQ ID NO: 1408894 - DNA, 22 bp, Artificial Sequence
  chemically synthesized
aaacttccaagtttgcctgtct

SEQ ID NO: 1408895 - DNA, 22 bp, Artificial Sequence
  chemically synthesized
ccaagtttgcctgtcttggggg

SEQ ID NO: 1408896 - DNA, 22 bp, Artificial Sequence
  chemically synthesized
aaaccataagtgcccccaagac

SEQ ID NO: 1408897 - DNA, 22 bp, Artificial Sequence
  chemically synthesized
caagtttgcctgtcttgggggc

SEQ ID NO: 1408898 - DNA, 22 bp, Artificial Sequence
  chemically synthesized
caaaccataagtgcccccaaga

SEQ ID NO: 1408899 - DNA, 22 bp, Artificial Sequence
  chemically synthesized
taatttcaaaccataagtgccc

SEQ ID NO: 1408900 - DNA, 22 bp, Artificial Sequence
  chemically synthesized
gcctgtcttgggggcacttatg

SEQ ID NO: 1408901 - DNA, 22 bp, Artificial Sequence
  chemically synthesized
cctgtcttgggggcacttatgg

SEQ ID NO: 1408902 - DNA, 22 bp, Artificial Sequence
  chemically synthesized
tgttataatttcaaaccataag

SEQ ID NO: 1408903 - DNA, 22 bp, Artificial Sequence
  chemically synthesized
tcttgggggcacttatggtttg

SEQ ID NO: 1408904 - DNA, 22 bp, Artificial Sequence
  chemically synthesized
gtgttataatttcaaaccataa

SEQ ID NO: 1408905 - DNA, 22 bp, Artificial Sequence
  chemically synthesized
ttgtgttataatttcaaaccat

SEQ ID NO: 1408906 - DNA, 22 bp, Artificial Sequence
  chemically synthesized
cttgtgttataatttcaaacca

SEQ ID NO: 1408907 - DNA, 22 bp, Artificial Sequence
  chemically synthesized
gggggcacttatggtttgaaat

SEQ ID NO: 1408908 - DNA, 22 bp, Artificial Sequence
  chemically synthesized
tcttgtgttataatttcaaacc

SEQ ID NO: 1408909 - DNA, 22 bp, Artificial Sequence
  chemically synthesized
ggggcacttatggtttgaaatt

SEQ ID NO: 1408910 - DNA, 22 bp, Artificial Sequence
  chemically synthesized
aactttcttgtgttataatttc

SEQ ID NO: 1408911 - DNA, 22 bp, Artificial Sequence
  chemically synthesized
aaactttcttgtgttataattt

SEQ ID NO: 1408912 - DNA, 22 bp, Artificial Sequence
  chemically synthesized
atggtttgaaattataacacaa

SEQ ID NO: 1408913 - DNA, 22 bp, Artificial Sequence
  chemically synthesized
tggtttgaaattataacacaag

SEQ ID NO: 1408914 - DNA, 22 bp, Artificial Sequence
  chemically synthesized
gaaattataacacaagaaagtt

SEQ ID NO: 1408915 - DNA, 22 bp, Artificial Sequence
  chemically synthesized
aaattataacacaagaaagttt

SEQ ID NO: 1408916 - DNA, 22 bp, Artificial Sequence
  chemically synthesized
atgaaaacacttaaactttctt

SEQ ID NO: 1408917 - DNA, 22 bp, Artificial Sequence
  chemically synthesized
tcatgaaaacacttaaactttc

SEQ ID NO: 1408918 - DNA, 22 bp, Artificial Sequence
  chemically synthesized
ctcatgaaaacacttaaacttt

SEQ ID NO: 1408919 - DNA, 22 bp, Artificial Sequence
  chemically synthesized
tctcatgaaaacacttaaactt

SEQ ID NO: 1408920 - DNA, 22 bp, Artificial Sequence
  chemically synthesized
ttctcatgaaaacacttaaact

SEQ ID NO: 1408921 - DNA, 22 bp, Artificial Sequence
  chemically synthesized
taacacaagaaagtttaagtgt

SEQ ID NO: 1408922 - DNA, 22 bp, Artificial Sequence
  chemically synthesized
atttttctcatgaaaacactta

SEQ ID NO: 1408923 - DNA, 22 bp, Artificial Sequence
  chemically synthesized
ttaatttttctcatgaaaacac

SEQ ID NO: 1408924 - DNA, 22 bp, Artificial Sequence
  chemically synthesized
attaatttttctcatgaaaaca

SEQ ID NO: 1408925 - DNA, 22 bp, Artificial Sequence
  chemically synthesized
tattaatttttctcatgaaaac

SEQ ID NO: 1408926 - DNA, 22 bp, Artificial Sequence
  chemically synthesized
aagtgttttcatgagaaaaatt

SEQ ID NO: 1408927 - DNA, 22 bp, Artificial Sequence
  chemically synthesized
agtgttttcatgagaaaaatta

SEQ ID NO: 1408928 - DNA, 22 bp, Artificial Sequence
  chemically synthesized
tcatgagaaaaattaataaaat

SEQ ID NO: 1408929 - DNA, 22 bp, Artificial Sequence
  chemically synthesized
catgagaaaaattaataaaatc

SEQ ID NO: 1408930 - DNA, 22 bp, Artificial Sequence
  chemically synthesized
atgagaaaaattaataaaatca

SEQ ID NO: 1408931 - DNA, 22 bp, Artificial Sequence
  chemically synthesized
agaggaaacatatgattttatt

SEQ ID NO: 1408932 - DNA, 22 bp, Artificial Sequence
  chemically synthesized
atacaaatctgagaggaaacat

SEQ ID NO: 1408933 - DNA, 22 bp, Artificial Sequence
  chemically synthesized
ataaaatcatatgtttcctctc

SEQ ID NO: 1408934 - DNA, 22 bp, Artificial Sequence
  chemically synthesized
aatacctaatacaaatctgaga

SEQ ID NO: 1408935 - DNA, 22 bp, Artificial Sequence
  chemically synthesized
acaaactaaatacctaatacaa

SEQ ID NO: 1408936 - DNA, 22 bp, Artificial Sequence
  chemically synthesized
cctctcagatttgtattaggta

SEQ ID NO: 1408937 - DNA, 22 bp, Artificial Sequence
  chemically synthesized
ctctcagatttgtattaggtat

SEQ ID NO: 1408938 - DNA, 22 bp, Artificial Sequence
  chemically synthesized
ctaacaaactaaatacctaata

SEQ ID NO: 1408939 - DNA, 22 bp, Artificial Sequence
  chemically synthesized
cctaacaaactaaatacctaat

SEQ ID NO: 1408940 - DNA, 22 bp, Artificial Sequence
  chemically synthesized
tcctaacaaactaaatacctaa

SEQ ID NO: 1408941 - DNA, 22 bp, Artificial Sequence
  chemically synthesized
tcagatttgtattaggtattta

SEQ ID NO: 1408942 - DNA, 22 bp, Artificial Sequence
  chemically synthesized
agatttgtattaggtatttagt

SEQ ID NO: 1408943 - DNA, 22 bp, Artificial Sequence
  chemically synthesized
gtattaggtatttagtttgtta

SEQ ID NO: 1408944 - DNA, 22 bp, Artificial Sequence
  chemically synthesized
tattaggtatttagtttgttag

SEQ ID NO: 1408945 - DNA, 22 bp, Artificial Sequence
  chemically synthesized
ggtatttagtttgttaggaaag

SEQ ID NO: 1408946 - DNA, 22 bp, Artificial Sequence
  chemically synthesized
tggtaggggggatagctttcct

SEQ ID NO: 1408947 - DNA, 22 bp, Artificial Sequence
  chemically synthesized
gtggtaggggggatagctttcc

SEQ ID NO: 1408948 - DNA, 22 bp, Artificial Sequence
  chemically synthesized
tgtggtaggggggatagctttc

SEQ ID NO: 1408949 - DNA, 22 bp, Artificial Sequence
  chemically synthesized
ttgtggtaggggggatagcttt

SEQ ID NO: 1408950 - DNA, 22 bp, Artificial Sequence
  chemically synthesized
agtttgttaggaaagctatccc

SEQ ID NO: 1408951 - DNA, 22 bp, Artificial Sequence
  chemically synthesized
tttgtggtaggggggatagctt

SEQ ID NO: 1408952 - DNA, 22 bp, Artificial Sequence
  chemically synthesized
gtttgttaggaaagctatcccc

SEQ ID NO: 1408953 - DNA, 22 bp, Artificial Sequence
  chemically synthesized
ctttttgtggtaggggggatag

SEQ ID NO: 1408954 - DNA, 22 bp, Artificial Sequence
  chemically synthesized
actttttgtggtaggggggata

SEQ ID NO: 1408955 - DNA, 22 bp, Artificial Sequence
  chemically synthesized
gttaggaaagctatccccccta

SEQ ID NO: 1408956 - DNA, 22 bp, Artificial Sequence
  chemically synthesized
ttaggaaagctatcccccctac

SEQ ID NO: 1408957 - DNA, 22 bp, Artificial Sequence
  chemically synthesized
tttactttttgtggtagggggg

SEQ ID NO: 1408958 - DNA, 22 bp, Artificial Sequence
  chemically synthesized
ggaaagctatcccccctaccac

SEQ ID NO: 1408959 - DNA, 22 bp, Artificial Sequence
  chemically synthesized
tctgtttactttttgtggtagg

SEQ ID NO: 1408960 - DNA, 22 bp, Artificial Sequence
  chemically synthesized
tcccccctaccacaaaaagtaa

SEQ ID NO: 1408961 - DNA, 22 bp, Artificial Sequence
  chemically synthesized
tgaaaccagctgtctgtttact

SEQ ID NO: 1408962 - DNA, 22 bp, Artificial Sequence
  chemically synthesized
ccacaaaaagtaaacagacagc

SEQ ID NO: 1408963 - DNA, 22 bp, Artificial Sequence
  chemically synthesized
ataatgtaactatgaaaccagc

SEQ ID NO: 1408964 - DNA, 22 bp, Artificial Sequence
  chemically synthesized
cataatgtaactatgaaaccag

SEQ ID NO: 1408965 - DNA, 22 bp, Artificial Sequence
  chemically synthesized
tagtttcataatgtaactatga

SEQ ID NO: 1408966 - DNA, 22 bp, Artificial Sequence
  chemically synthesized
atagtttcataatgtaactatg

SEQ ID NO: 1408967 - DNA, 22 bp, Artificial Sequence
  chemically synthesized
cttatagtttcataatgtaact

SEQ ID NO: 1408968 - DNA, 22 bp, Artificial Sequence
  chemically synthesized
ttccttatagtttcataatgta

SEQ ID NO: 1408969 - DNA, 22 bp, Artificial Sequence
  chemically synthesized
gtttcatagttacattatgaaa

SEQ ID NO: 1408970 - DNA, 22 bp, Artificial Sequence
  chemically synthesized
catagttacattatgaaactat

SEQ ID NO: 1408971 - DNA, 22 bp, Artificial Sequence
  chemically synthesized
atagttacattatgaaactata

SEQ ID NO: 1408972 - DNA, 22 bp, Artificial Sequence
  chemically synthesized
aatgagttattccttatagttt

SEQ ID NO: 1408973 - DNA, 22 bp, Artificial Sequence
  chemically synthesized
cattatgaaactataaggaata

SEQ ID NO: 1408974 - DNA, 22 bp, Artificial Sequence
  chemically synthesized
tgaaactataaggaataactca

SEQ ID NO: 1408975 - DNA, 22 bp, Artificial Sequence
  chemically synthesized
acatatgctaaatgagttattc

SEQ ID NO: 1408976 - DNA, 22 bp, Artificial Sequence
  chemically synthesized
cacatatgctaaatgagttatt

SEQ ID NO: 1408977 - DNA, 22 bp, Artificial Sequence
  chemically synthesized
taaggaataactcatttagcat

SEQ ID NO: 1408978 - DNA, 22 bp, Artificial Sequence
  chemically synthesized
gcatatttcacatatgctaaat

SEQ ID NO: 1408979 - DNA, 22 bp, Artificial Sequence
  chemically synthesized
atttagcatatgtgaaatatgc

SEQ ID NO: 1408980 - DNA, 22 bp, Artificial Sequence
  chemically synthesized
agaatagcgatattggcatatt

SEQ ID NO: 1408981 - DNA, 22 bp, Artificial Sequence
  chemically synthesized
agcatatgtgaaatatgccaat

SEQ ID NO: 1408982 - DNA, 22 bp, Artificial Sequence
  chemically synthesized
cagaatagcgatattggcatat

SEQ ID NO: 1408983 - DNA, 22 bp, Artificial Sequence
  chemically synthesized
gcatatgtgaaatatgccaata

SEQ ID NO: 1408984 - DNA, 22 bp, Artificial Sequence
  chemically synthesized
tttcagaatagcgatattggca

SEQ ID NO: 1408985 - DNA, 22 bp, Artificial Sequence
  chemically synthesized
ggaaaacactatttcagaatag

SEQ ID NO: 1408986 - DNA, 22 bp, Artificial Sequence
  chemically synthesized
aggaaaacactatttcagaata

SEQ ID NO: 1408987 - DNA, 22 bp, Artificial Sequence
  chemically synthesized
ttctgaaatagtgttttcctaa

SEQ ID NO: 1408988 - DNA, 22 bp, Artificial Sequence
  chemically synthesized
tgaaatagtgttttcctaaggg

SEQ ID NO: 1408989 - DNA, 22 bp, Artificial Sequence
  chemically synthesized
aaatagtgttttcctaaggggt

SEQ ID NO: 1408990 - DNA, 22 bp, Artificial Sequence
  chemically synthesized
tcctaaggggttatggtgtgtg

SEQ ID NO: 1408991 - DNA, 22 bp, Artificial Sequence
  chemically synthesized
cctaaggggttatggtgtgtgt

SEQ ID NO: 1408992 - DNA, 22 bp, Artificial Sequence
  chemically synthesized
ctaaggggttatggtgtgtgtg

SEQ ID NO: 1408993 - DNA, 22 bp, Artificial Sequence
  chemically synthesized
aggggttatggtgtgtgtgtgt

SEQ ID NO: 1408994 - DNA, 22 bp, Artificial Sequence
  chemically synthesized
tggtgtgtgtgtgtgtgtgtgt

SEQ ID NO: 1408995 - DNA, 22 bp, Artificial Sequence
  chemically synthesized
cacacaaagcacacacacacac

SEQ ID NO: 1408996 - DNA, 22 bp, Artificial Sequence
  chemically synthesized
gcacacaaagcacacacacaca

SEQ ID NO: 1408997 - DNA, 22 bp, Artificial Sequence
  chemically synthesized
aaatgtatgagtacttgcacac

SEQ ID NO: 1408998 - DNA, 22 bp, Artificial Sequence
  chemically synthesized
tgtgtgcaagtactcatacatt

SEQ ID NO: 1408999 - DNA, 22 bp, Artificial Sequence
  chemically synthesized
gtgtgcaagtactcatacattt

SEQ ID NO: 1409000 - DNA, 22 bp, Artificial Sequence
  chemically synthesized
tgtgcaagtactcatacatttt

SEQ ID NO: 1409001 - DNA, 22 bp, Artificial Sequence
  chemically synthesized
atacattttagctattctactt

SEQ ID NO: 1409002 - DNA, 22 bp, Artificial Sequence
  chemically synthesized
tacaaaaatcaaatggaagtag

SEQ ID NO: 1409003 - DNA, 22 bp, Artificial Sequence
  chemically synthesized
ttatacaaaaatcaaatggaag

SEQ ID NO: 1409004 - DNA, 22 bp, Artificial Sequence
  chemically synthesized
tagctattctacttccatttga

SEQ ID NO: 1409005 - DNA, 22 bp, Artificial Sequence
  chemically synthesized
gttatacaaaaatcaaatggaa

SEQ ID NO: 1409006 - DNA, 22 bp, Artificial Sequence
  chemically synthesized
agctattctacttccatttgat

SEQ ID NO: 1409007 - DNA, 22 bp, Artificial Sequence
  chemically synthesized
gctattctacttccatttgatt

SEQ ID NO: 1409008 - DNA, 22 bp, Artificial Sequence
  chemically synthesized
tgtttgttatacaaaaatcaaa

SEQ ID NO: 1409009 - DNA, 22 bp, Artificial Sequence
  chemically synthesized
ttctacttccatttgatttttg

SEQ ID NO: 1409010 - DNA, 22 bp, Artificial Sequence
  chemically synthesized
gtgtttgttatacaaaaatcaa

SEQ ID NO: 1409011 - DNA, 22 bp, Artificial Sequence
  chemically synthesized
tacttccatttgatttttgtat

SEQ ID NO: 1409012 - DNA, 22 bp, Artificial Sequence
  chemically synthesized
tttgtgtttgttatacaaaaat

SEQ ID NO: 1409013 - DNA, 22 bp, Artificial Sequence
  chemically synthesized
cttccatttgatttttgtataa

SEQ ID NO: 1409014 - DNA, 22 bp, Artificial Sequence
  chemically synthesized
ccatttgatttttgtataacaa

SEQ ID NO: 1409015 - DNA, 22 bp, Artificial Sequence
  chemically synthesized
catttgatttttgtataacaaa

SEQ ID NO: 1409016 - DNA, 22 bp, Artificial Sequence
  chemically synthesized
gatttttgtataacaaacacaa

SEQ ID NO: 1409017 - DNA, 22 bp, Artificial Sequence
  chemically synthesized
atttttgtataacaaacacaaa

SEQ ID NO: 1409018 - DNA, 22 bp, Artificial Sequence
  chemically synthesized
atatatagggattatttgtgtt

SEQ ID NO: 1409019 - DNA, 22 bp, Artificial Sequence
  chemically synthesized
gatatatagggattatttgtgt

SEQ ID NO: 1409020 - DNA, 22 bp, Artificial Sequence
  chemically synthesized
ttgtataacaaacacaaataat

SEQ ID NO: 1409021 - DNA, 22 bp, Artificial Sequence
  chemically synthesized
tgtataacaaacacaaataatc

SEQ ID NO: 1409022 - DNA, 22 bp, Artificial Sequence
  chemically synthesized
gtataacaaacacaaataatcc

SEQ ID NO: 1409023 - DNA, 22 bp, Artificial Sequence
  chemically synthesized
tataacaaacacaaataatccc

SEQ ID NO: 1409024 - DNA, 22 bp, Artificial Sequence
  chemically synthesized
tgtatatcttgatatataggga

SEQ ID NO: 1409025 - DNA, 22 bp, Artificial Sequence
  chemically synthesized
ttgtgtatatcttgatatatag

SEQ ID NO: 1409026 - DNA, 22 bp, Artificial Sequence
  chemically synthesized
attgttgtgtatatcttgatat

SEQ ID NO: 1409027 - DNA, 22 bp, Artificial Sequence
  chemically synthesized
ctgattgttgtgtatatcttga

SEQ ID NO: 1409028 - DNA, 22 bp, Artificial Sequence
  chemically synthesized
taagttactgattgttgtgtat

SEQ ID NO: 1409029 - DNA, 22 bp, Artificial Sequence
  chemically synthesized
tatatcaagatatacacaacaa

SEQ ID NO: 1409030 - DNA, 22 bp, Artificial Sequence
  chemically synthesized
ataaactataagttactgattg

SEQ ID NO: 1409031 - DNA, 22 bp, Artificial Sequence
  chemically synthesized
tatctaataaactataagttac

SEQ ID NO: 1409032 - DNA, 22 bp, Artificial Sequence
  chemically synthesized
taaattatatctaataaactat

SEQ ID NO: 1409033 - DNA, 22 bp, Artificial Sequence
  chemically synthesized
ataaattatatctaataaacta

SEQ ID NO: 1409034 - DNA, 22 bp, Artificial Sequence
  chemically synthesized
catttataaattatatctaata

SEQ ID NO: 1409035 - DNA, 22 bp, Artificial Sequence
  chemically synthesized
gcatttataaattatatctaat

SEQ ID NO: 1409036 - DNA, 22 bp, Artificial Sequence
  chemically synthesized
ttgcatttataaattatatcta

SEQ ID NO: 1409037 - DNA, 22 bp, Artificial Sequence
  chemically synthesized
cttgcatttataaattatatct

SEQ ID NO: 1409038 - DNA, 22 bp, Artificial Sequence
  chemically synthesized
atagtttattagatataattta

SEQ ID NO: 1409039 - DNA, 22 bp, Artificial Sequence
  chemically synthesized
tagtttattagatataatttat

SEQ ID NO: 1409040 - DNA, 22 bp, Artificial Sequence
  chemically synthesized
tttcttgcatttataaattata

SEQ ID NO: 1409041 - DNA, 22 bp, Artificial Sequence
  chemically synthesized
atttcttgcatttataaattat

SEQ ID NO: 1409042 - DNA, 22 bp, Artificial Sequence
  chemically synthesized
attagatataatttataaatgc

SEQ ID NO: 1409043 - DNA, 22 bp, Artificial Sequence
  chemically synthesized
ttagatataatttataaatgca

SEQ ID NO: 1409044 - DNA, 22 bp, Artificial Sequence
  chemically synthesized
aggtttatttcttgcatttata

SEQ ID NO: 1409045 - DNA, 22 bp, Artificial Sequence
  chemically synthesized
caggtttatttcttgcatttat

SEQ ID NO: 1409046 - DNA, 22 bp, Artificial Sequence
  chemically synthesized
tcaggtttatttcttgcattta

SEQ ID NO: 1409047 - DNA, 22 bp, Artificial Sequence
  chemically synthesized
gatataatttataaatgcaaga

SEQ ID NO: 1409048 - DNA, 22 bp, Artificial Sequence
  chemically synthesized
tctttcaggtttatttcttgca

SEQ ID NO: 1409049 - DNA, 22 bp, Artificial Sequence
  chemically synthesized
atctttcaggtttatttcttgc

SEQ ID NO: 1409050 - DNA, 22 bp, Artificial Sequence
  chemically synthesized
aacttatctttcaggtttattt

SEQ ID NO: 1409051 - DNA, 22 bp, Artificial Sequence
  chemically synthesized
ataaatgcaagaaataaacctg

SEQ ID NO: 1409052 - DNA, 22 bp, Artificial Sequence
  chemically synthesized
taaatgcaagaaataaacctga

SEQ ID NO: 1409053 - DNA, 22 bp, Artificial Sequence
  chemically synthesized
atatggactcaacttatctttc

SEQ ID NO: 1409054 - DNA, 22 bp, Artificial Sequence
  chemically synthesized
gtggattcatatggactcaact

SEQ ID NO: 1409055 - DNA, 22 bp, Artificial Sequence
  chemically synthesized
ggtggattcatatggactcaac

SEQ ID NO: 1409056 - DNA, 22 bp, Artificial Sequence
  chemically synthesized
aaagataagttgagtccatatg

SEQ ID NO: 1409057 - DNA, 22 bp, Artificial Sequence
  chemically synthesized
gagaaatcttggtggattcata

SEQ ID NO: 1409058 - DNA, 22 bp, Artificial Sequence
  chemically synthesized
agagaaatcttggtggattcat

SEQ ID NO: 1409059 - DNA, 22 bp, Artificial Sequence
  chemically synthesized
tagagaaatcttggtggattca

SEQ ID NO: 1409060 - DNA, 22 bp, Artificial Sequence
  chemically synthesized
ttttagagaaatcttggtggat

SEQ ID NO: 1409061 - DNA, 22 bp, Artificial Sequence
  chemically synthesized
agtccatatgaatccaccaaga

SEQ ID NO: 1409062 - DNA, 22 bp, Artificial Sequence
  chemically synthesized
tgtggaatgatatgtatattat

SEQ ID NO: 1409063 - DNA, 22 bp, Artificial Sequence
  chemically synthesized
ctctaaaataatatacatatca

SEQ ID NO: 1409064 - DNA, 22 bp, Artificial Sequence
  chemically synthesized
tctaaaataatatacatatcat

SEQ ID NO: 1409065 - DNA, 22 bp, Artificial Sequence
  chemically synthesized
agagttgtgtggaatgatatgt

SEQ ID NO: 1409066 - DNA, 22 bp, Artificial Sequence
  chemically synthesized
taaaataatatacatatcattc

SEQ ID NO: 1409067 - DNA, 22 bp, Artificial Sequence
  chemically synthesized
cagagttgtgtggaatgatatg

SEQ ID NO: 1409068 - DNA, 22 bp, Artificial Sequence
  chemically synthesized
tcagagttgtgtggaatgatat

SEQ ID NO: 1409069 - DNA, 22 bp, Artificial Sequence
  chemically synthesized
aaataatatacatatcattcca

SEQ ID NO: 1409070 - DNA, 22 bp, Artificial Sequence
  chemically synthesized
atataccagtattttcagagtt

SEQ ID NO: 1409071 - DNA, 22 bp, Artificial Sequence
  chemically synthesized
cacacaactctgaaaatactgg

SEQ ID NO: 1409072 - DNA, 22 bp, Artificial Sequence
  chemically synthesized
tgaaaatactggtatatcaatt

SEQ ID NO: 1409073 - DNA, 22 bp, Artificial Sequence
  chemically synthesized
aaaatactggtatatcaattac

SEQ ID NO: 1409074 - DNA, 22 bp, Artificial Sequence
  chemically synthesized
tgtaaaatagcagtaattgata

SEQ ID NO: 1409075 - DNA, 22 bp, Artificial Sequence
  chemically synthesized
atgtaaaatagcagtaattgat

SEQ ID NO: 1409076 - DNA, 22 bp, Artificial Sequence
  chemically synthesized
tatgtaaaatagcagtaattga

SEQ ID NO: 1409077 - DNA, 22 bp, Artificial Sequence
  chemically synthesized
ttatgtaaaatagcagtaattg

SEQ ID NO: 1409078 - DNA, 22 bp, Artificial Sequence
  chemically synthesized
tttatgtaaaatagcagtaatt

SEQ ID NO: 1409079 - DNA, 22 bp, Artificial Sequence
  chemically synthesized
gtatatcaattactgctatttt

SEQ ID NO: 1409080 - DNA, 22 bp, Artificial Sequence
  chemically synthesized
atcaccgaagactttttatgta

SEQ ID NO: 1409081 - DNA, 22 bp, Artificial Sequence
  chemically synthesized
ctgctattttacataaaaagtc

SEQ ID NO: 1409082 - DNA, 22 bp, Artificial Sequence
  chemically synthesized
ctattttacataaaaagtcttc

SEQ ID NO: 1409083 - DNA, 22 bp, Artificial Sequence
  chemically synthesized
ttttacataaaaagtcttcggt

SEQ ID NO: 1409084 - DNA, 22 bp, Artificial Sequence
  chemically synthesized
tacataaaaagtcttcggtgat

SEQ ID NO: 1409085 - DNA, 22 bp, Artificial Sequence
  chemically synthesized
acataaaaagtcttcggtgatt

SEQ ID NO: 1409086 - DNA, 22 bp, Artificial Sequence
  chemically synthesized
cataaaaagtcttcggtgatta

SEQ ID NO: 1409087 - DNA, 22 bp, Artificial Sequence
  chemically synthesized
aaatagatatgctaatcaccga

SEQ ID NO: 1409088 - DNA, 22 bp, Artificial Sequence
  chemically synthesized
taaaatagatatgctaatcacc

SEQ ID NO: 1409089 - DNA, 22 bp, Artificial Sequence
  chemically synthesized
aatctctaaaatagatatgcta

SEQ ID NO: 1409090 - DNA, 22 bp, Artificial Sequence
  chemically synthesized
tcaatctctaaaatagatatgc

SEQ ID NO: 1409091 - DNA, 22 bp, Artificial Sequence
  chemically synthesized
cggtgattagcatatctatttt

SEQ ID NO: 1409092 - DNA, 22 bp, Artificial Sequence
  chemically synthesized
ttctcaatctctaaaatagata

SEQ ID NO: 1409093 - DNA, 22 bp, Artificial Sequence
  chemically synthesized
ggtgattagcatatctatttta

SEQ ID NO: 1409094 - DNA, 22 bp, Artificial Sequence
  chemically synthesized
tgctattctcaatctctaaaat

SEQ ID NO: 1409095 - DNA, 22 bp, Artificial Sequence
  chemically synthesized
atgctattctcaatctctaaaa

SEQ ID NO: 1409096 - DNA, 22 bp, Artificial Sequence
  chemically synthesized
gcatatctattttagagattga

SEQ ID NO: 1409097 - DNA, 22 bp, Artificial Sequence
  chemically synthesized
ttttagagattgagaatagcat

SEQ ID NO: 1409098 - DNA, 22 bp, Artificial Sequence
  chemically synthesized
tagagattgagaatagcataaa

SEQ ID NO: 1409099 - DNA, 22 bp, Artificial Sequence
  chemically synthesized
agagattgagaatagcataaat

SEQ ID NO: 1409100 - DNA, 22 bp, Artificial Sequence
  chemically synthesized
gagattgagaatagcataaatg

SEQ ID NO: 1409101 - DNA, 22 bp, Artificial Sequence
  chemically synthesized
agaatagcataaatgccatgtg

SEQ ID NO: 1409102 - DNA, 22 bp, Artificial Sequence
  chemically synthesized
gtagaagccaagaatacaacaa

SEQ ID NO: 1409103 - DNA, 22 bp, Artificial Sequence
  chemically synthesized
tttttgttgtattcttggcttc

SEQ ID NO: 1409104 - DNA, 22 bp, Artificial Sequence
  chemically synthesized
gagaggctagtagaagccaaga

SEQ ID NO: 1409105 - DNA, 22 bp, Artificial Sequence
  chemically synthesized
ttttgttgtattcttggcttct

SEQ ID NO: 1409106 - DNA, 22 bp, Artificial Sequence
  chemically synthesized
tttgttgtattcttggcttcta

SEQ ID NO: 1409107 - DNA, 22 bp, Artificial Sequence
  chemically synthesized
ttgttgtattcttggcttctac

SEQ ID NO: 1409108 - DNA, 22 bp, Artificial Sequence
  chemically synthesized
tgttgtattcttggcttctact

SEQ ID NO: 1409109 - DNA, 22 bp, Artificial Sequence
  chemically synthesized
gttgtattcttggcttctacta

SEQ ID NO: 1409110 - DNA, 22 bp, Artificial Sequence
  chemically synthesized
agctggagaggctagtagaagc

SEQ ID NO: 1409111 - DNA, 22 bp, Artificial Sequence
  chemically synthesized
ttgtattcttggcttctactag

SEQ ID NO: 1409112 - DNA, 22 bp, Artificial Sequence
  chemically synthesized
aagctggagaggctagtagaag

SEQ ID NO: 1409113 - DNA, 22 bp, Artificial Sequence
  chemically synthesized
tattcttggcttctactagcct

SEQ ID NO: 1409114 - DNA, 22 bp, Artificial Sequence
  chemically synthesized
ttggcttctactagcctctcca

SEQ ID NO: 1409115 - DNA, 22 bp, Artificial Sequence
  chemically synthesized
ggcttctactagcctctccagc

SEQ ID NO: 1409116 - DNA, 22 bp, Artificial Sequence
  chemically synthesized
gcttctactagcctctccagct

SEQ ID NO: 1409117 - DNA, 22 bp, Artificial Sequence
  chemically synthesized
ctactagcctctccagcttaaa

SEQ ID NO: 1409118 - DNA, 22 bp, Artificial Sequence
  chemically synthesized
tactagcctctccagcttaaac

SEQ ID NO: 1409119 - DNA, 22 bp, Artificial Sequence
  chemically synthesized
ctagcctctccagcttaaactc

SEQ ID NO: 1409120 - DNA, 22 bp, Artificial Sequence
  chemically synthesized
gcctctccagcttaaactcttg

SEQ ID NO: 1409121 - DNA, 22 bp, Artificial Sequence
  chemically synthesized
tccagcttaaactcttgcctct

SEQ ID NO: 1409122 - DNA, 22 bp, Artificial Sequence
  chemically synthesized
cagcttaaactcttgcctctct

SEQ ID NO: 1409123 - DNA, 22 bp, Artificial Sequence
  chemically synthesized
aaactcttgcctctcttcctct

SEQ ID NO: 1409124 - DNA, 22 bp, Artificial Sequence
  chemically synthesized
aactcttgcctctcttcctctt

SEQ ID NO: 1409125 - DNA, 22 bp, Artificial Sequence
  chemically synthesized
gaataaagtataaagaggaaga

SEQ ID NO: 1409126 - DNA, 22 bp, Artificial Sequence
  chemically synthesized
ttgcctctcttcctctttatac

SEQ ID NO: 1409127 - DNA, 22 bp, Artificial Sequence
  chemically synthesized
tggctggaataaagtataaaga

SEQ ID NO: 1409128 - DNA, 22 bp, Artificial Sequence
  chemically synthesized
gcctctcttcctctttatactt

SEQ ID NO: 1409129 - DNA, 22 bp, Artificial Sequence
  chemically synthesized
cctctcttcctctttatacttt

SEQ ID NO: 1409130 - DNA, 22 bp, Artificial Sequence
  chemically synthesized
tcttcctctttatactttattc

SEQ ID NO: 1409131 - DNA, 22 bp, Artificial Sequence
  chemically synthesized
ttcctctttatactttattcca

SEQ ID NO: 1409132 - DNA, 22 bp, Artificial Sequence
  chemically synthesized
cctctttatactttattccagc

SEQ ID NO: 1409133 - DNA, 22 bp, Artificial Sequence
  chemically synthesized
ctctttatactttattccagcc

SEQ ID NO: 1409134 - DNA, 22 bp, Artificial Sequence
  chemically synthesized
tttatactttattccagccaca

SEQ ID NO: 1409135 - DNA, 22 bp, Artificial Sequence
  chemically synthesized
tatactttattccagccacaat

SEQ ID NO: 1409136 - DNA, 22 bp, Artificial Sequence
  chemically synthesized
atactttattccagccacaatg

SEQ ID NO: 1409137 - DNA, 22 bp, Artificial Sequence
  chemically synthesized
tactttattccagccacaatgg

SEQ ID NO: 1409138 - DNA, 22 bp, Artificial Sequence
  chemically synthesized
tattccagccacaatggacttc

SEQ ID NO: 1409139 - DNA, 22 bp, Artificial Sequence
  chemically synthesized
gaagaaaaaatagaagtccatt

SEQ ID NO: 1409140 - DNA, 22 bp, Artificial Sequence
  chemically synthesized
attccagccacaatggacttct

SEQ ID NO: 1409141 - DNA, 22 bp, Artificial Sequence
  chemically synthesized
agaagaaaaaatagaagtccat

SEQ ID NO: 1409142 - DNA, 22 bp, Artificial Sequence
  chemically synthesized
ttccagccacaatggacttcta

SEQ ID NO: 1409143 - DNA, 22 bp, Artificial Sequence
  chemically synthesized
tagaagaaaaaatagaagtcca

SEQ ID NO: 1409144 - DNA, 22 bp, Artificial Sequence
  chemically synthesized
cagccacaatggacttctattt

SEQ ID NO: 1409145 - DNA, 22 bp, Artificial Sequence
  chemically synthesized
ctattttttcttctaaaatgct

SEQ ID NO: 1409146 - DNA, 22 bp, Artificial Sequence
  chemically synthesized
tattttttcttctaaaatgctg

SEQ ID NO: 1409147 - DNA, 22 bp, Artificial Sequence
  chemically synthesized
ttttttcttctaaaatgctgga

SEQ ID NO: 1409148 - DNA, 22 bp, Artificial Sequence
  chemically synthesized
aaacaggaaggagtccagcatt

SEQ ID NO: 1409149 - DNA, 22 bp, Artificial Sequence
  chemically synthesized
tttcttctaaaatgctggactc

SEQ ID NO: 1409150 - DNA, 22 bp, Artificial Sequence
  chemically synthesized
ttcttctaaaatgctggactcc

SEQ ID NO: 1409151 - DNA, 22 bp, Artificial Sequence
  chemically synthesized
tcttctaaaatgctggactcct

SEQ ID NO: 1409152 - DNA, 22 bp, Artificial Sequence
  chemically synthesized
cttctaaaatgctggactcctt

SEQ ID NO: 1409153 - DNA, 22 bp, Artificial Sequence
  chemically synthesized
ttctaaaatgctggactccttc

SEQ ID NO: 1409154 - DNA, 22 bp, Artificial Sequence
  chemically synthesized
ctaaaatgctggactccttcct

SEQ ID NO: 1409155 - DNA, 22 bp, Artificial Sequence
  chemically synthesized
taaaatgctggactccttcctg

SEQ ID NO: 1409156 - DNA, 22 bp, Artificial Sequence
  chemically synthesized
aaatgctggactccttcctgtt

SEQ ID NO: 1409157 - DNA, 22 bp, Artificial Sequence
  chemically synthesized
gactccttcctgtttcagatat

SEQ ID NO: 1409158 - DNA, 22 bp, Artificial Sequence
  chemically synthesized
cttcctgtttcagatattttcc

SEQ ID NO: 1409159 - DNA, 22 bp, Artificial Sequence
  chemically synthesized
cctgtttcagatattttccgta

SEQ ID NO: 1409160 - DNA, 22 bp, Artificial Sequence
  chemically synthesized
ctgtttcagatattttccgtat

SEQ ID NO: 1409161 - DNA, 22 bp, Artificial Sequence
  chemically synthesized
tttcagatattttccgtattct

SEQ ID NO: 1409162 - DNA, 22 bp, Artificial Sequence
  chemically synthesized
tgaatagatgaaacagaatacg

SEQ ID NO: 1409163 - DNA, 22 bp, Artificial Sequence
  chemically synthesized
cagatattttccgtattctgtt

SEQ ID NO: 1409164 - DNA, 22 bp, Artificial Sequence
  chemically synthesized
atgaatagatgaaacagaatac

SEQ ID NO: 1409165 - DNA, 22 bp, Artificial Sequence
  chemically synthesized
agatattttccgtattctgttt

SEQ ID NO: 1409166 - DNA, 22 bp, Artificial Sequence
  chemically synthesized
tccgtattctgtttcatctatt

SEQ ID NO: 1409167 - DNA, 22 bp, Artificial Sequence
  chemically synthesized
ccgtattctgtttcatctattc

SEQ ID NO: 1409168 - DNA, 22 bp, Artificial Sequence
  chemically synthesized
cgtattctgtttcatctattca

SEQ ID NO: 1409169 - DNA, 22 bp, Artificial Sequence
  chemically synthesized
aagacagacttatgaatagatg

SEQ ID NO: 1409170 - DNA, 22 bp, Artificial Sequence
  chemically synthesized
tgtttcatctattcataagtct

SEQ ID NO: 1409171 - DNA, 22 bp, Artificial Sequence
  chemically synthesized
tttcatctattcataagtctgt

SEQ ID NO: 1409172 - DNA, 22 bp, Artificial Sequence
  chemically synthesized
acaagcctcaagacagacttat

SEQ ID NO: 1409173 - DNA, 22 bp, Artificial Sequence
  chemically synthesized
cacaagcctcaagacagactta

SEQ ID NO: 1409174 - DNA, 22 bp, Artificial Sequence
  chemically synthesized
tcacaagcctcaagacagactt

SEQ ID NO: 1409175 - DNA, 22 bp, Artificial Sequence
  chemically synthesized
catctattcataagtctgtctt

SEQ ID NO: 1409176 - DNA, 22 bp, Artificial Sequence
  chemically synthesized
atctattcataagtctgtcttg

SEQ ID NO: 1409177 - DNA, 22 bp, Artificial Sequence
  chemically synthesized
attttcacaagcctcaagacag

SEQ ID NO: 1409178 - DNA, 22 bp, Artificial Sequence
  chemically synthesized
ttcataagtctgtcttgaggct

SEQ ID NO: 1409179 - DNA, 22 bp, Artificial Sequence
  chemically synthesized
ataagtctgtcttgaggcttgt

SEQ ID NO: 1409180 - DNA, 22 bp, Artificial Sequence
  chemically synthesized
caaaaaattaattttcacaagc

SEQ ID NO: 1409181 - DNA, 22 bp, Artificial Sequence
  chemically synthesized
acaaaaaattaattttcacaag

SEQ ID NO: 1409182 - DNA, 22 bp, Artificial Sequence
  chemically synthesized
tacaaaaaattaattttcacaa

SEQ ID NO: 1409183 - DNA, 22 bp, Artificial Sequence
  chemically synthesized
ttacaaaaaattaattttcaca

SEQ ID NO: 1409184 - DNA, 22 bp, Artificial Sequence
  chemically synthesized
tcttgaggcttgtgaaaattaa

SEQ ID NO: 1409185 - DNA, 22 bp, Artificial Sequence
  chemically synthesized
gaggcttgtgaaaattaatttt

SEQ ID NO: 1409186 - DNA, 22 bp, Artificial Sequence
  chemically synthesized
aggcttgtgaaaattaattttt

SEQ ID NO: 1409187 - DNA, 22 bp, Artificial Sequence
  chemically synthesized
tatacatttttacaaaaaatta

SEQ ID NO: 1409188 - DNA, 22 bp, Artificial Sequence
  chemically synthesized
gtatacatttttacaaaaaatt

SEQ ID NO: 1409189 - DNA, 22 bp, Artificial Sequence
  chemically synthesized
gtgaaaattaattttttgtaaa

SEQ ID NO: 1409190 - DNA, 22 bp, Artificial Sequence
  chemically synthesized
tgaaaattaattttttgtaaaa

SEQ ID NO: 1409191 - DNA, 22 bp, Artificial Sequence
  chemically synthesized
tacaacttgtatacatttttac

SEQ ID NO: 1409192 - DNA, 22 bp, Artificial Sequence
  chemically synthesized
attttttgtaaaaatgtataca

SEQ ID NO: 1409193 - DNA, 22 bp, Artificial Sequence
  chemically synthesized
tttgtaaaaatgtatacaagtt

SEQ ID NO: 1409194 - DNA, 22 bp, Artificial Sequence
  chemically synthesized
ttgtaaaaatgtatacaagttg

SEQ ID NO: 1409195 - DNA, 22 bp, Artificial Sequence
  chemically synthesized
aaacatgttgtacaacttgtat

SEQ ID NO: 1409196 - DNA, 22 bp, Artificial Sequence
  chemically synthesized
tgtaaaaatgtatacaagttgt

SEQ ID NO: 1409197 - DNA, 22 bp, Artificial Sequence
  chemically synthesized
gtaaaaatgtatacaagttgta

SEQ ID NO: 1409198 - DNA, 22 bp, Artificial Sequence
  chemically synthesized
taaaaatgtatacaagttgtac

SEQ ID NO: 1409199 - DNA, 22 bp, Artificial Sequence
  chemically synthesized
tatgtatattgaaacatgttgt

SEQ ID NO: 1409200 - DNA, 22 bp, Artificial Sequence
  chemically synthesized
actatatgtatattgaaacatg

SEQ ID NO: 1409201 - DNA, 22 bp, Artificial Sequence
  chemically synthesized
cactatatgtatattgaaacat

SEQ ID NO: 1409202 - DNA, 22 bp, Artificial Sequence
  chemically synthesized
tacaacatgtttcaatatacat

SEQ ID NO: 1409203 - DNA, 22 bp, Artificial Sequence
  chemically synthesized
tagtaatcatttcactatatgt

SEQ ID NO: 1409204 - DNA, 22 bp, Artificial Sequence
  chemically synthesized
ctgtagtaatcatttcactata

SEQ ID NO: 1409205 - DNA, 22 bp, Artificial Sequence
  chemically synthesized
actgtagtaatcatttcactat

SEQ ID NO: 1409206 - DNA, 22 bp, Artificial Sequence
  chemically synthesized
tactgtagtaatcatttcacta

SEQ ID NO: 1409207 - DNA, 22 bp, Artificial Sequence
  chemically synthesized
caatatacatatagtgaaatga

SEQ ID NO: 1409208 - DNA, 22 bp, Artificial Sequence
  chemically synthesized
ttactgtagtaatcatttcact

SEQ ID NO: 1409209 - DNA, 22 bp, Artificial Sequence
  chemically synthesized
aatatacatatagtgaaatgat

SEQ ID NO: 1409210 - DNA, 22 bp, Artificial Sequence
  chemically synthesized
cttttactgtagtaatcatttc

SEQ ID NO: 1409211 - DNA, 22 bp, Artificial Sequence
  chemically synthesized
attacttttactgtagtaatca

SEQ ID NO: 1409212 - DNA, 22 bp, Artificial Sequence
  chemically synthesized
ctacagtaaaagtaattaacat

SEQ ID NO: 1409213 - DNA, 22 bp, Artificial Sequence
  chemically synthesized
cagtaaaagtaattaacatatc

SEQ ID NO: 1409214 - DNA, 22 bp, Artificial Sequence
  chemically synthesized
acatatccatcctcttacatgg

SEQ ID NO: 1409215 - DNA, 22 bp, Artificial Sequence
  chemically synthesized
ttacatggttaccctttttttg

SEQ ID NO: 1409216 - DNA, 22 bp, Artificial Sequence
  chemically synthesized
tcaccaaatacacaaaaaaagg

SEQ ID NO: 1409217 - DNA, 22 bp, Artificial Sequence
  chemically synthesized
acatggttaccctttttttgtg

SEQ ID NO: 1409218 - DNA, 22 bp, Artificial Sequence
  chemically synthesized
catggttaccctttttttgtgt

SEQ ID NO: 1409219 - DNA, 22 bp, Artificial Sequence
  chemically synthesized
agtgttatcaccaaatacacaa

SEQ ID NO: 1409220 - DNA, 22 bp, Artificial Sequence
  chemically synthesized
gagtgttatcaccaaatacaca

SEQ ID NO: 1409221 - DNA, 22 bp, Artificial Sequence
  chemically synthesized
ccctttttttgtgtatttggtg

SEQ ID NO: 1409222 - DNA, 22 bp, Artificial Sequence
  chemically synthesized
tttttgtgtatttggtgataac

SEQ ID NO: 1409223 - DNA, 22 bp, Artificial Sequence
  chemically synthesized
ttttgtgtatttggtgataaca

SEQ ID NO: 1409224 - DNA, 22 bp, Artificial Sequence
  chemically synthesized
tttgtgtatttggtgataacac

SEQ ID NO: 1409225 - DNA, 22 bp, Artificial Sequence
  chemically synthesized
ttgtgtatttggtgataacact

SEQ ID NO: 1409226 - DNA, 22 bp, Artificial Sequence
  chemically synthesized
tgtgtatttggtgataacactc

SEQ ID NO: 1409227 - DNA, 22 bp, Artificial Sequence
  chemically synthesized
gtgtatttggtgataacactca

SEQ ID NO: 1409228 - DNA, 22 bp, Artificial Sequence
  chemically synthesized
agagagtaatcttgagtgttat

SEQ ID NO: 1409229 - DNA, 22 bp, Artificial Sequence
  chemically synthesized
tgtatttggtgataacactcaa

SEQ ID NO: 1409230 - DNA, 22 bp, Artificial Sequence
  chemically synthesized
ggtgataacactcaagattact

SEQ ID NO: 1409231 - DNA, 22 bp, Artificial Sequence
  chemically synthesized
gtgataacactcaagattactc

SEQ ID NO: 1409232 - DNA, 22 bp, Artificial Sequence
  chemically synthesized
cagtatgcactaagagagtaat

SEQ ID NO: 1409233 - DNA, 22 bp, Artificial Sequence
  chemically synthesized
aagattactctcttagtgcata

SEQ ID NO: 1409234 - DNA, 22 bp, Artificial Sequence
  chemically synthesized
ataacactacagtatgcactaa

SEQ ID NO: 1409235 - DNA, 22 bp, Artificial Sequence
  chemically synthesized
tagttaataacactacagtatg

SEQ ID NO: 1409236 - DNA, 22 bp, Artificial Sequence
  chemically synthesized
ctctcttagtgcatactgtagt

SEQ ID NO: 1409237 - DNA, 22 bp, Artificial Sequence
  chemically synthesized
tcttagtgcatactgtagtgtt

SEQ ID NO: 1409238 - DNA, 22 bp, Artificial Sequence
  chemically synthesized
ttagtgcatactgtagtgttat

SEQ ID NO: 1409239 - DNA, 22 bp, Artificial Sequence
  chemically synthesized
agtgcatactgtagtgttatta

SEQ ID NO: 1409240 - DNA, 22 bp, Artificial Sequence
  chemically synthesized
gtgcatactgtagtgttattaa

SEQ ID NO: 1409241 - DNA, 22 bp, Artificial Sequence
  chemically synthesized
tagtgttattaactatagcccc

SEQ ID NO: 1409242 - DNA, 22 bp, Artificial Sequence
  chemically synthesized
atgtgcaggataggggctatag

SEQ ID NO: 1409243 - DNA, 22 bp, Artificial Sequence
  chemically synthesized
ttaactatagcccctatcctgc

SEQ ID NO: 1409244 - DNA, 22 bp, Artificial Sequence
  chemically synthesized
gagatctaatgtgcaggatagg

SEQ ID NO: 1409245 - DNA, 22 bp, Artificial Sequence
  chemically synthesized
tagagatctaatgtgcaggata

SEQ ID NO: 1409246 - DNA, 22 bp, Artificial Sequence
  chemically synthesized
actatagcccctatcctgcaca

SEQ ID NO: 1409247 - DNA, 22 bp, Artificial Sequence
  chemically synthesized
tagcccctatcctgcacattag

SEQ ID NO: 1409248 - DNA, 22 bp, Artificial Sequence
  chemically synthesized
tcctgcacattagatctctaga

SEQ ID NO: 1409249 - DNA, 22 bp, Artificial Sequence
  chemically synthesized
tcaggatgaataagttctagag

SEQ ID NO: 1409250 - DNA, 22 bp, Artificial Sequence
  chemically synthesized
cacattagatctctagaactta

SEQ ID NO: 1409251 - DNA, 22 bp, Artificial Sequence
  chemically synthesized
attatcaggatgaataagttct

SEQ ID NO: 1409252 - DNA, 22 bp, Artificial Sequence
  chemically synthesized
cattatcaggatgaataagttc

SEQ ID NO: 1409253 - DNA, 22 bp, Artificial Sequence
  chemically synthesized
tcattatcaggatgaataagtt

SEQ ID NO: 1409254 - DNA, 22 bp, Artificial Sequence
  chemically synthesized
gatctctagaacttattcatcc

SEQ ID NO: 1409255 - DNA, 22 bp, Artificial Sequence
  chemically synthesized
tagaacttattcatcctgataa

SEQ ID NO: 1409256 - DNA, 22 bp, Artificial Sequence
  chemically synthesized
gaacttattcatcctgataatg

SEQ ID NO: 1409257 - DNA, 22 bp, Artificial Sequence
  chemically synthesized
attcatcctgataatgaaaact

SEQ ID NO: 1409258 - DNA, 22 bp, Artificial Sequence
  chemically synthesized
ttcatcctgataatgaaaactc

SEQ ID NO: 1409259 - DNA, 22 bp, Artificial Sequence
  chemically synthesized
gtcaaaggacacagagttttca

SEQ ID NO: 1409260 - DNA, 22 bp, Artificial Sequence
  chemically synthesized
atcctgataatgaaaactctgt

SEQ ID NO: 1409261 - DNA, 22 bp, Artificial Sequence
  chemically synthesized
ataatgaaaactctgtgtcctt

SEQ ID NO: 1409262 - DNA, 22 bp, Artificial Sequence
  chemically synthesized
tgtgtcctttgaccaatatctt

SEQ ID NO: 1409263 - DNA, 22 bp, Artificial Sequence
  chemically synthesized
tgtcctttgaccaatatcttcc

SEQ ID NO: 1409264 - DNA, 22 bp, Artificial Sequence
  chemically synthesized
tgaccaatatcttcccattctc

SEQ ID NO: 1409265 - DNA, 22 bp, Artificial Sequence
  chemically synthesized
gaccaatatcttcccattctcc

SEQ ID NO: 1409266 - DNA, 22 bp, Artificial Sequence
  chemically synthesized
accaatatcttcccattctccc

SEQ ID NO: 1409267 - DNA, 22 bp, Artificial Sequence
  chemically synthesized
ccaagggcagagggagggggag

SEQ ID NO: 1409268 - DNA, 22 bp, Artificial Sequence
  chemically synthesized
ttaccaagggcagagggagggg

SEQ ID NO: 1409269 - DNA, 22 bp, Artificial Sequence
  chemically synthesized
cccattctccccctccctctgc

SEQ ID NO: 1409270 - DNA, 22 bp, Artificial Sequence
  chemically synthesized
ccattctccccctccctctgcc

SEQ ID NO: 1409271 - DNA, 22 bp, Artificial Sequence
  chemically synthesized
attgttaccaagggcagaggga

SEQ ID NO: 1409272 - DNA, 22 bp, Artificial Sequence
  chemically synthesized
tccccctccctctgcccttggt

SEQ ID NO: 1409273 - DNA, 22 bp, Artificial Sequence
  chemically synthesized
cccctccctctgcccttggtaa

SEQ ID NO: 1409274 - DNA, 22 bp, Artificial Sequence
  chemically synthesized
cctctgcccttggtaacaatca

SEQ ID NO: 1409275 - DNA, 22 bp, Artificial Sequence
  chemically synthesized
tgcccttggtaacaatcaatct

SEQ ID NO: 1409276 - DNA, 22 bp, Artificial Sequence
  chemically synthesized
cccttggtaacaatcaatctac

SEQ ID NO: 1409277 - DNA, 22 bp, Artificial Sequence
  chemically synthesized
taaagaagcagagggtagattg

SEQ ID NO: 1409278 - DNA, 22 bp, Artificial Sequence
  chemically synthesized
ggtaacaatcaatctaccctct

SEQ ID NO: 1409279 - DNA, 22 bp, Artificial Sequence
  chemically synthesized
gtaacaatcaatctaccctctg

SEQ ID NO: 1409280 - DNA, 22 bp, Artificial Sequence
  chemically synthesized
aacagtcagctataaagaagca

SEQ ID NO: 1409281 - DNA, 22 bp, Artificial Sequence
  chemically synthesized
ccctctgcttctttatagctga

SEQ ID NO: 1409282 - DNA, 22 bp, Artificial Sequence
  chemically synthesized
tgcttctttatagctgactgtt

SEQ ID NO: 1409283 - DNA, 22 bp, Artificial Sequence
  chemically synthesized
catgtaaaatctgaacagtcag

SEQ ID NO: 1409284 - DNA, 22 bp, Artificial Sequence
  chemically synthesized
cttctttatagctgactgttca

SEQ ID NO: 1409285 - DNA, 22 bp, Artificial Sequence
  chemically synthesized
acatgtaaaatctgaacagtca

SEQ ID NO: 1409286 - DNA, 22 bp, Artificial Sequence
  chemically synthesized
ctttatagctgactgttcagat

SEQ ID NO: 1409287 - DNA, 22 bp, Artificial Sequence
  chemically synthesized
tttatagctgactgttcagatt

SEQ ID NO: 1409288 - DNA, 22 bp, Artificial Sequence
  chemically synthesized
acttacatgtaaaatctgaaca

SEQ ID NO: 1409289 - DNA, 22 bp, Artificial Sequence
  chemically synthesized
tatagctgactgttcagatttt

SEQ ID NO: 1409290 - DNA, 22 bp, Artificial Sequence
  chemically synthesized
atagctgactgttcagatttta

SEQ ID NO: 1409291 - DNA, 22 bp, Artificial Sequence
  chemically synthesized
tagctgactgttcagattttac

SEQ ID NO: 1409292 - DNA, 22 bp, Artificial Sequence
  chemically synthesized
catgatctcacttacatgtaaa

SEQ ID NO: 1409293 - DNA, 22 bp, Artificial Sequence
  chemically synthesized
actgttcagattttacatgtaa

SEQ ID NO: 1409294 - DNA, 22 bp, Artificial Sequence
  chemically synthesized
ttcagattttacatgtaagtga

SEQ ID NO: 1409295 - DNA, 22 bp, Artificial Sequence
  chemically synthesized
agattttacatgtaagtgagat

SEQ ID NO: 1409296 - DNA, 22 bp, Artificial Sequence
  chemically synthesized
tacatgtaagtgagatcatgca

SEQ ID NO: 1409297 - DNA, 22 bp, Artificial Sequence
  chemically synthesized
acatgtaagtgagatcatgcag

SEQ ID NO: 1409298 - DNA, 22 bp, Artificial Sequence
  chemically synthesized
catgtaagtgagatcatgcagt

SEQ ID NO: 1409299 - DNA, 22 bp, Artificial Sequence
  chemically synthesized
agtgaaataagccaggcatagg

SEQ ID NO: 1409300 - DNA, 22 bp, Artificial Sequence
  chemically synthesized
cgctaagtgaaataagccaggc

SEQ ID NO: 1409301 - DNA, 22 bp, Artificial Sequence
  chemically synthesized
ttcttcctatgcctggcttatt

SEQ ID NO: 1409302 - DNA, 22 bp, Artificial Sequence
  chemically synthesized
ttcctatgcctggcttatttca

SEQ ID NO: 1409303 - DNA, 22 bp, Artificial Sequence
  chemically synthesized
cctatgcctggcttatttcact

SEQ ID NO: 1409304 - DNA, 22 bp, Artificial Sequence
  chemically synthesized
ctatgcctggcttatttcactt

SEQ ID NO: 1409305 - DNA, 22 bp, Artificial Sequence
  chemically synthesized
aagaacattacgctaagtgaaa

SEQ ID NO: 1409306 - DNA, 22 bp, Artificial Sequence
  chemically synthesized
tgcctggcttatttcacttagc

SEQ ID NO: 1409307 - DNA, 22 bp, Artificial Sequence
  chemically synthesized
gcttatttcacttagcgtaatg

SEQ ID NO: 1409308 - DNA, 22 bp, Artificial Sequence
  chemically synthesized
atttcacttagcgtaatgttct

SEQ ID NO: 1409309 - DNA, 22 bp, Artificial Sequence
  chemically synthesized
tttcacttagcgtaatgttctt

SEQ ID NO: 1409310 - DNA, 22 bp, Artificial Sequence
  chemically synthesized
cacttagcgtaatgttcttcag

SEQ ID NO: 1409311 - DNA, 22 bp, Artificial Sequence
  chemically synthesized
acttagcgtaatgttcttcagg

SEQ ID NO: 1409312 - DNA, 22 bp, Artificial Sequence
  chemically synthesized
agcgtaatgttcttcaggttca

SEQ ID NO: 1409313 - DNA, 22 bp, Artificial Sequence
  chemically synthesized
tgataatgtgggtgaacctgaa

SEQ ID NO: 1409314 - DNA, 22 bp, Artificial Sequence
  chemically synthesized
gcgtaatgttcttcaggttcac

SEQ ID NO: 1409315 - DNA, 22 bp, Artificial Sequence
  chemically synthesized
gtgataatgtgggtgaacctga

SEQ ID NO: 1409316 - DNA, 22 bp, Artificial Sequence
  chemically synthesized
tttgtgataatgtgggtgaacc

SEQ ID NO: 1409317 - DNA, 22 bp, Artificial Sequence
  chemically synthesized
ctatttgtgataatgtgggtga

SEQ ID NO: 1409318 - DNA, 22 bp, Artificial Sequence
  chemically synthesized
ttcaggttcacccacattatca

SEQ ID NO: 1409319 - DNA, 22 bp, Artificial Sequence
  chemically synthesized
caggttcacccacattatcaca

SEQ ID NO: 1409320 - DNA, 22 bp, Artificial Sequence
  chemically synthesized
aggttcacccacattatcacaa

SEQ ID NO: 1409321 - DNA, 22 bp, Artificial Sequence
  chemically synthesized
acccacattatcacaaatagca

SEQ ID NO: 1409322 - DNA, 22 bp, Artificial Sequence
  chemically synthesized
caaaggaaggaaatcctgctat

SEQ ID NO: 1409323 - DNA, 22 bp, Artificial Sequence
  chemically synthesized
gcctacaaaggaaggaaatcct

SEQ ID NO: 1409324 - DNA, 22 bp, Artificial Sequence
  chemically synthesized
tcacaaatagcaggatttcctt

SEQ ID NO: 1409325 - DNA, 22 bp, Artificial Sequence
  chemically synthesized
agcctacaaaggaaggaaatcc

SEQ ID NO: 1409326 - DNA, 22 bp, Artificial Sequence
  chemically synthesized
ccttcctttgtaggctaaatat

SEQ ID NO: 1409327 - DNA, 22 bp, Artificial Sequence
  chemically synthesized
cttcctttgtaggctaaatatt

SEQ ID NO: 1409328 - DNA, 22 bp, Artificial Sequence
  chemically synthesized
cctttgtaggctaaatattatt

SEQ ID NO: 1409329 - DNA, 22 bp, Artificial Sequence
  chemically synthesized
ctttgtaggctaaatattattt

SEQ ID NO: 1409330 - DNA, 22 bp, Artificial Sequence
  chemically synthesized
tgtaggctaaatattatttcat

SEQ ID NO: 1409331 - DNA, 22 bp, Artificial Sequence
  chemically synthesized
gtaggctaaatattatttcatt

SEQ ID NO: 1409332 - DNA, 22 bp, Artificial Sequence
  chemically synthesized
taggctaaatattatttcatta

SEQ ID NO: 1409333 - DNA, 22 bp, Artificial Sequence
  chemically synthesized
tgatatatgtaaatataatgaa

SEQ ID NO: 1409334 - DNA, 22 bp, Artificial Sequence
  chemically synthesized
aatattatttcattatatttac

SEQ ID NO: 1409335 - DNA, 22 bp, Artificial Sequence
  chemically synthesized
tttcattatatttacatatatc

SEQ ID NO: 1409336 - DNA, 22 bp, Artificial Sequence
  chemically synthesized
ataaagaaattgtgatatatgt

SEQ ID NO: 1409337 - DNA, 22 bp, Artificial Sequence
  chemically synthesized
cattatatttacatatatcaca

SEQ ID NO: 1409338 - DNA, 22 bp, Artificial Sequence
  chemically synthesized
attatatttacatatatcacaa

SEQ ID NO: 1409339 - DNA, 22 bp, Artificial Sequence
  chemically synthesized
tatttacatatatcacaatttc

SEQ ID NO: 1409340 - DNA, 22 bp, Artificial Sequence
  chemically synthesized
acatatatcacaatttctttat

SEQ ID NO: 1409341 - DNA, 22 bp, Artificial Sequence
  chemically synthesized
catatatcacaatttctttatt

SEQ ID NO: 1409342 - DNA, 22 bp, Artificial Sequence
  chemically synthesized
agtgtacatcaacagataaatt

SEQ ID NO: 1409343 - DNA, 22 bp, Artificial Sequence
  chemically synthesized
ctttattaatttatctgttgat

SEQ ID NO: 1409344 - DNA, 22 bp, Artificial Sequence
  chemically synthesized
tttattaatttatctgttgatg

SEQ ID NO: 1409345 - DNA, 22 bp, Artificial Sequence
  chemically synthesized
tattaatttatctgttgatgta

SEQ ID NO: 1409346 - DNA, 22 bp, Artificial Sequence
  chemically synthesized
attaatttatctgttgatgtac

SEQ ID NO: 1409347 - DNA, 22 bp, Artificial Sequence
  chemically synthesized
ttaatttatctgttgatgtaca

SEQ ID NO: 1409348 - DNA, 22 bp, Artificial Sequence
  chemically synthesized
atttatctgttgatgtacactc

SEQ ID NO: 1409349 - DNA, 22 bp, Artificial Sequence
  chemically synthesized
atctgttgatgtacactcaggt

SEQ ID NO: 1409350 - DNA, 22 bp, Artificial Sequence
  chemically synthesized
tctgttgatgtacactcaggtt

SEQ ID NO: 1409351 - DNA, 22 bp, Artificial Sequence
  chemically synthesized
ttgatgtacactcaggttgttt

SEQ ID NO: 1409352 - DNA, 22 bp, Artificial Sequence
  chemically synthesized
atgtacactcaggttgttttca

SEQ ID NO: 1409353 - DNA, 22 bp, Artificial Sequence
  chemically synthesized
acaatagccaaggcatgaaaac

SEQ ID NO: 1409354 - DNA, 22 bp, Artificial Sequence
  chemically synthesized
ttcacaatagccaaggcatgaa

SEQ ID NO: 1409355 - DNA, 22 bp, Artificial Sequence
  chemically synthesized
aggttgttttcatgccttggct

SEQ ID NO: 1409356 - DNA, 22 bp, Artificial Sequence
  chemically synthesized
ttttcatgccttggctattgtg

SEQ ID NO: 1409357 - DNA, 22 bp, Artificial Sequence
  chemically synthesized
agtgcagagttattcacaatag

SEQ ID NO: 1409358 - DNA, 22 bp, Artificial Sequence
  chemically synthesized
tcatgccttggctattgtgaat

SEQ ID NO: 1409359 - DNA, 22 bp, Artificial Sequence
  chemically synthesized
catgccttggctattgtgaata

SEQ ID NO: 1409360 - DNA, 22 bp, Artificial Sequence
  chemically synthesized
atgccttggctattgtgaataa

SEQ ID NO: 1409361 - DNA, 22 bp, Artificial Sequence
  chemically synthesized
ccatgttcagtgcagagttatt

SEQ ID NO: 1409362 - DNA, 22 bp, Artificial Sequence
  chemically synthesized
ggctattgtgaataactctgca

SEQ ID NO: 1409363 - DNA, 22 bp, Artificial Sequence
  chemically synthesized
gctattgtgaataactctgcac

SEQ ID NO: 1409364 - DNA, 22 bp, Artificial Sequence
  chemically synthesized
cactcccatgttcagtgcagag

SEQ ID NO: 1409365 - DNA, 22 bp, Artificial Sequence
  chemically synthesized
ttgtgaataactctgcactgaa

SEQ ID NO: 1409366 - DNA, 22 bp, Artificial Sequence
  chemically synthesized
tgaataactctgcactgaacat

SEQ ID NO: 1409367 - DNA, 22 bp, Artificial Sequence
  chemically synthesized
gatgagatatctgcactcccat

SEQ ID NO: 1409368 - DNA, 22 bp, Artificial Sequence
  chemically synthesized
tgcactgaacatgggagtgcag

SEQ ID NO: 1409369 - DNA, 22 bp, Artificial Sequence
  chemically synthesized
cactgaacatgggagtgcagat

SEQ ID NO: 1409370 - DNA, 22 bp, Artificial Sequence
  chemically synthesized
aacatgggagtgcagatatctc

SEQ ID NO: 1409371 - DNA, 22 bp, Artificial Sequence
  chemically synthesized
atctagatactgatttcatttc

SEQ ID NO: 1409372 - DNA, 22 bp, Artificial Sequence
  chemically synthesized
ggtatatataaaaaggaaatga

SEQ ID NO: 1409373 - DNA, 22 bp, Artificial Sequence
  chemically synthesized
gggtatatataaaaaggaaatg

SEQ ID NO: 1409374 - DNA, 22 bp, Artificial Sequence
  chemically synthesized
gatactgatttcatttcctttt

SEQ ID NO: 1409375 - DNA, 22 bp, Artificial Sequence
  chemically synthesized
tgggtatatataaaaaggaaat

SEQ ID NO: 1409376 - DNA, 22 bp, Artificial Sequence
  chemically synthesized
ttgggtatatataaaaaggaaa

SEQ ID NO: 1409377 - DNA, 22 bp, Artificial Sequence
  chemically synthesized
ttttgggtatatataaaaagga

SEQ ID NO: 1409378 - DNA, 22 bp, Artificial Sequence
  chemically synthesized
atttcatttcctttttatatat

SEQ ID NO: 1409379 - DNA, 22 bp, Artificial Sequence
  chemically synthesized
ccactcttttgggtatatataa

SEQ ID NO: 1409380 - DNA, 22 bp, Artificial Sequence
  chemically synthesized
catttcctttttatatataccc

SEQ ID NO: 1409381 - DNA, 22 bp, Artificial Sequence
  chemically synthesized
atttcctttttatatataccca

SEQ ID NO: 1409382 - DNA, 22 bp, Artificial Sequence
  chemically synthesized
cctttttatatatacccaaaag

SEQ ID NO: 1409383 - DNA, 22 bp, Artificial Sequence
  chemically synthesized
ctttttatatatacccaaaaga

SEQ ID NO: 1409384 - DNA, 22 bp, Artificial Sequence
  chemically synthesized
tttatatatacccaaaagagtg

SEQ ID NO: 1409385 - DNA, 22 bp, Artificial Sequence
  chemically synthesized
ggatcaaattaccactcttttg

SEQ ID NO: 1409386 - DNA, 22 bp, Artificial Sequence
  chemically synthesized
ttatatatacccaaaagagtgg

SEQ ID NO: 1409387 - DNA, 22 bp, Artificial Sequence
  chemically synthesized
tatatatacccaaaagagtggt

SEQ ID NO: 1409388 - DNA, 22 bp, Artificial Sequence
  chemically synthesized
atatatacccaaaagagtggta

SEQ ID NO: 1409389 - DNA, 22 bp, Artificial Sequence
  chemically synthesized
tatatacccaaaagagtggtaa

SEQ ID NO: 1409390 - DNA, 22 bp, Artificial Sequence
  chemically synthesized
aaatacgaatgccctaggatca

SEQ ID NO: 1409391 - DNA, 22 bp, Artificial Sequence
  chemically synthesized
aaaaagttaaaatacgaatgcc

SEQ ID NO: 1409392 - DNA, 22 bp, Artificial Sequence
  chemically synthesized
ctcaaaaagttaaaatacgaat

SEQ ID NO: 1409393 - DNA, 22 bp, Artificial Sequence
  chemically synthesized
gatcctagggcattcgtatttt

SEQ ID NO: 1409394 - DNA, 22 bp, Artificial Sequence
  chemically synthesized
atcctagggcattcgtatttta

SEQ ID NO: 1409395 - DNA, 22 bp, Artificial Sequence
  chemically synthesized
gggcattcgtattttaactttt

SEQ ID NO: 1409396 - DNA, 22 bp, Artificial Sequence
  chemically synthesized
gtattttaactttttgaggaat

SEQ ID NO: 1409397 - DNA, 22 bp, Artificial Sequence
  chemically synthesized
tggaaaacagtatggagattcc

SEQ ID NO: 1409398 - DNA, 22 bp, Artificial Sequence
  chemically synthesized
taactttttgaggaatctccat

SEQ ID NO: 1409399 - DNA, 22 bp, Artificial Sequence
  chemically synthesized
aactttttgaggaatctccata

SEQ ID NO: 1409400 - DNA, 22 bp, Artificial Sequence
  chemically synthesized
actttttgaggaatctccatac

SEQ ID NO: 1409401 - DNA, 22 bp, Artificial Sequence
  chemically synthesized
tttgaggaatctccatactgtt

SEQ ID NO: 1409402 - DNA, 22 bp, Artificial Sequence
  chemically synthesized
ttgaggaatctccatactgttt

SEQ ID NO: 1409403 - DNA, 22 bp, Artificial Sequence
  chemically synthesized
tgaggaatctccatactgtttt

SEQ ID NO: 1409404 - DNA, 22 bp, Artificial Sequence
  chemically synthesized
gaggaatctccatactgttttc

SEQ ID NO: 1409405 - DNA, 22 bp, Artificial Sequence
  chemically synthesized
aggaatctccatactgttttcc

SEQ ID NO: 1409406 - DNA, 22 bp, Artificial Sequence
  chemically synthesized
tatagccattatggaaaacagt

SEQ ID NO: 1409407 - DNA, 22 bp, Artificial Sequence
  chemically synthesized
gtatagccattatggaaaacag

SEQ ID NO: 1409408 - DNA, 22 bp, Artificial Sequence
  chemically synthesized
catactgttttccataatggct

SEQ ID NO: 1409409 - DNA, 22 bp, Artificial Sequence
  chemically synthesized
ttttccataatggctatacaaa

SEQ ID NO: 1409410 - DNA, 22 bp, Artificial Sequence
  chemically synthesized
gcgggaatgtaaatttgtatag

SEQ ID NO: 1409411 - DNA, 22 bp, Artificial Sequence
  chemically synthesized
tccataatggctatacaaattt

SEQ ID NO: 1409412 - DNA, 22 bp, Artificial Sequence
  chemically synthesized
ccataatggctatacaaattta

SEQ ID NO: 1409413 - DNA, 22 bp, Artificial Sequence
  chemically synthesized
ttggcgggaatgtaaatttgta

SEQ ID NO: 1409414 - DNA, 22 bp, Artificial Sequence
  chemically synthesized
cataatggctatacaaatttac

SEQ ID NO: 1409415 - DNA, 22 bp, Artificial Sequence
  chemically synthesized
tacattgttggcgggaatgtaa

SEQ ID NO: 1409416 - DNA, 22 bp, Artificial Sequence
  chemically synthesized
atacattgttggcgggaatgta

SEQ ID NO: 1409417 - DNA, 22 bp, Artificial Sequence
  chemically synthesized
tacaaatttacattcccgccaa

SEQ ID NO: 1409418 - DNA, 22 bp, Artificial Sequence
  chemically synthesized
acattcccgccaacaatgtata

SEQ ID NO: 1409419 - DNA, 22 bp, Artificial Sequence
  chemically synthesized
cattcccgccaacaatgtataa

SEQ ID NO: 1409420 - DNA, 22 bp, Artificial Sequence
  chemically synthesized
ccgccaacaatgtataaggatt

SEQ ID NO: 1409421 - DNA, 22 bp, Artificial Sequence
  chemically synthesized
gcaagaatgtggataaaaggga

SEQ ID NO: 1409422 - DNA, 22 bp, Artificial Sequence
  chemically synthesized
ggcaagaatgtggataaaaggg

SEQ ID NO: 1409423 - DNA, 22 bp, Artificial Sequence
  chemically synthesized
tggcaagaatgtggataaaagg

SEQ ID NO: 1409424 - DNA, 22 bp, Artificial Sequence
  chemically synthesized
ccttttatccacattcttgcca

SEQ ID NO: 1409425 - DNA, 22 bp, Artificial Sequence
  chemically synthesized
ttatccacattcttgccaaaac

SEQ ID NO: 1409426 - DNA, 22 bp, Artificial Sequence
  chemically synthesized
tatccacattcttgccaaaact

SEQ ID NO: 1409427 - DNA, 22 bp, Artificial Sequence
  chemically synthesized
atccacattcttgccaaaactt

SEQ ID NO: 1409428 - DNA, 22 bp, Artificial Sequence
  chemically synthesized
tccacattcttgccaaaacttg

SEQ ID NO: 1409429 - DNA, 22 bp, Artificial Sequence
  chemically synthesized
ttgccaaaacttgttatttttt

SEQ ID NO: 1409430 - DNA, 22 bp, Artificial Sequence
  chemically synthesized
tcaaaaagataaaaaaaataac

SEQ ID NO: 1409431 - DNA, 22 bp, Artificial Sequence
  chemically synthesized
gccaaaacttgttatttttttt

SEQ ID NO: 1409432 - DNA, 22 bp, Artificial Sequence
  chemically synthesized
ccaaaacttgttatttttttta

SEQ ID NO: 1409433 - DNA, 22 bp, Artificial Sequence
  chemically synthesized
ttatcaaaaagataaaaaaaat

SEQ ID NO: 1409434 - DNA, 22 bp, Artificial Sequence
  chemically synthesized
gttattttttttatctttttga

SEQ ID NO: 1409435 - DNA, 22 bp, Artificial Sequence
  chemically synthesized
ggatggctattatcaaaaagat

SEQ ID NO: 1409436 - DNA, 22 bp, Artificial Sequence
  chemically synthesized
ttattttttttatctttttgat

SEQ ID NO: 1409437 - DNA, 22 bp, Artificial Sequence
  chemically synthesized
ttaggatggctattatcaaaaa

SEQ ID NO: 1409438 - DNA, 22 bp, Artificial Sequence
  chemically synthesized
ttttttttatctttttgataat

SEQ ID NO: 1409439 - DNA, 22 bp, Artificial Sequence
  chemically synthesized
gttaggatggctattatcaaaa

SEQ ID NO: 1409440 - DNA, 22 bp, Artificial Sequence
  chemically synthesized
tttttatctttttgataatagc

SEQ ID NO: 1409441 - DNA, 22 bp, Artificial Sequence
  chemically synthesized
ttttatctttttgataatagcc

SEQ ID NO: 1409442 - DNA, 22 bp, Artificial Sequence
  chemically synthesized
tttatctttttgataatagcca

SEQ ID NO: 1409443 - DNA, 22 bp, Artificial Sequence
  chemically synthesized
ttatctttttgataatagccat

SEQ ID NO: 1409444 - DNA, 22 bp, Artificial Sequence
  chemically synthesized
aaacttgttaggatggctatta

SEQ ID NO: 1409445 - DNA, 22 bp, Artificial Sequence
  chemically synthesized
tatctttttgataatagccatc

SEQ ID NO: 1409446 - DNA, 22 bp, Artificial Sequence
  chemically synthesized
atctttttgataatagccatcc

SEQ ID NO: 1409447 - DNA, 22 bp, Artificial Sequence
  chemically synthesized
tctttttgataatagccatcct

SEQ ID NO: 1409448 - DNA, 22 bp, Artificial Sequence
  chemically synthesized
tttgataatagccatcctaaca

SEQ ID NO: 1409449 - DNA, 22 bp, Artificial Sequence
  chemically synthesized
ttgataatagccatcctaacaa

SEQ ID NO: 1409450 - DNA, 22 bp, Artificial Sequence
  chemically synthesized
tgataatagccatcctaacaag

SEQ ID NO: 1409451 - DNA, 22 bp, Artificial Sequence
  chemically synthesized
gataatagccatcctaacaagt

SEQ ID NO: 1409452 - DNA, 22 bp, Artificial Sequence
  chemically synthesized
ataatagccatcctaacaagtt

SEQ ID NO: 1409453 - DNA, 22 bp, Artificial Sequence
  chemically synthesized
aagcaacagtgaaatatcacct

SEQ ID NO: 1409454 - DNA, 22 bp, Artificial Sequence
  chemically synthesized
acaagtttgaggtgatatttca

SEQ ID NO: 1409455 - DNA, 22 bp, Artificial Sequence
  chemically synthesized
gaggtgatatttcactgttgct

SEQ ID NO: 1409456 - DNA, 22 bp, Artificial Sequence
  chemically synthesized
aggtgatatttcactgttgctt

SEQ ID NO: 1409457 - DNA, 22 bp, Artificial Sequence
  chemically synthesized
atcatcaaggaaatgcaaatta

SEQ ID NO: 1409458 - DNA, 22 bp, Artificial Sequence
  chemically synthesized
cactgttgctttaatttgcatt

SEQ ID NO: 1409459 - DNA, 22 bp, Artificial Sequence
  chemically synthesized
actgttgctttaatttgcattt

SEQ ID NO: 1409460 - DNA, 22 bp, Artificial Sequence
  chemically synthesized
ttgctttaatttgcatttcctt

SEQ ID NO: 1409461 - DNA, 22 bp, Artificial Sequence
  chemically synthesized
ctttaatttgcatttccttgat

SEQ ID NO: 1409462 - DNA, 22 bp, Artificial Sequence
  chemically synthesized
aaaagcgctaatcatcaaggaa

SEQ ID NO: 1409463 - DNA, 22 bp, Artificial Sequence
  chemically synthesized
taatttgcatttccttgatgat

SEQ ID NO: 1409464 - DNA, 22 bp, Artificial Sequence
  chemically synthesized
tcaaaagcgctaatcatcaagg

SEQ ID NO: 1409465 - DNA, 22 bp, Artificial Sequence
  chemically synthesized
aatttgcatttccttgatgatt

SEQ ID NO: 1409466 - DNA, 22 bp, Artificial Sequence
  chemically synthesized
atttgcatttccttgatgatta

SEQ ID NO: 1409467 - DNA, 22 bp, Artificial Sequence
  chemically synthesized
gcatttccttgatgattagcgc

SEQ ID NO: 1409468 - DNA, 22 bp, Artificial Sequence
  chemically synthesized
catttccttgatgattagcgct

SEQ ID NO: 1409469 - DNA, 22 bp, Artificial Sequence
  chemically synthesized
ccttgatgattagcgcttttga

SEQ ID NO: 1409470 - DNA, 22 bp, Artificial Sequence
  chemically synthesized
cttgatgattagcgcttttgag

SEQ ID NO: 1409471 - DNA, 22 bp, Artificial Sequence
  chemically synthesized
gatgattagcgcttttgagaat

SEQ ID NO: 1409472 - DNA, 22 bp, Artificial Sequence
  chemically synthesized
atgattagcgcttttgagaatc

SEQ ID NO: 1409473 - DNA, 22 bp, Artificial Sequence
  chemically synthesized
gcgcttttgagaatcttttcat

SEQ ID NO: 1409474 - DNA, 22 bp, Artificial Sequence
  chemically synthesized
ttgagaatcttttcatatacct

SEQ ID NO: 1409475 - DNA, 22 bp, Artificial Sequence
  chemically synthesized
tgagaatcttttcatatacctg

SEQ ID NO: 1409476 - DNA, 22 bp, Artificial Sequence
  chemically synthesized
gagaatcttttcatatacctgt

SEQ ID NO: 1409477 - DNA, 22 bp, Artificial Sequence
  chemically synthesized
agaatcttttcatatacctgtt

SEQ ID NO: 1409478 - DNA, 22 bp, Artificial Sequence
  chemically synthesized
ttcatatacctgttggccattt

SEQ ID NO: 1409479 - DNA, 22 bp, Artificial Sequence
  chemically synthesized
tcatatacctgttggccatttg

SEQ ID NO: 1409480 - DNA, 22 bp, Artificial Sequence
  chemically synthesized
catatacctgttggccatttgc

SEQ ID NO: 1409481 - DNA, 22 bp, Artificial Sequence
  chemically synthesized
caaagaagacatgcaaatggcc

SEQ ID NO: 1409482 - DNA, 22 bp, Artificial Sequence
  chemically synthesized
atatacctgttggccatttgca

SEQ ID NO: 1409483 - DNA, 22 bp, Artificial Sequence
  chemically synthesized
tccaaagaagacatgcaaatgg

SEQ ID NO: 1409484 - DNA, 22 bp, Artificial Sequence
  chemically synthesized
ttggccatttgcatgtcttctt

SEQ ID NO: 1409485 - DNA, 22 bp, Artificial Sequence
  chemically synthesized
gccatttgcatgtcttctttgg

SEQ ID NO: 1409486 - DNA, 22 bp, Artificial Sequence
  chemically synthesized
aatagacagttctccaaagaag

SEQ ID NO: 1409487 - DNA, 22 bp, Artificial Sequence
  chemically synthesized
gcatgtcttctttggagaactg

SEQ ID NO: 1409488 - DNA, 22 bp, Artificial Sequence
  chemically synthesized
catgtcttctttggagaactgt

SEQ ID NO: 1409489 - DNA, 22 bp, Artificial Sequence
  chemically synthesized
ctttggagaactgtctattcag

SEQ ID NO: 1409490 - DNA, 22 bp, Artificial Sequence
  chemically synthesized
tttggagaactgtctattcagg

SEQ ID NO: 1409491 - DNA, 22 bp, Artificial Sequence
  chemically synthesized
tggagaactgtctattcagggg

SEQ ID NO: 1409492 - DNA, 22 bp, Artificial Sequence
  chemically synthesized
ggagaactgtctattcaggggc

SEQ ID NO: 1409493 - DNA, 22 bp, Artificial Sequence
  chemically synthesized
aaaatggtcaaagcccctgaat

SEQ ID NO: 1409494 - DNA, 22 bp, Artificial Sequence
  chemically synthesized
gagaactgtctattcaggggct

SEQ ID NO: 1409495 - DNA, 22 bp, Artificial Sequence
  chemically synthesized
attaaaaatggtcaaagcccct

SEQ ID NO: 1409496 - DNA, 22 bp, Artificial Sequence
  chemically synthesized
tctattcaggggctttgaccat

SEQ ID NO: 1409497 - DNA, 22 bp, Artificial Sequence
  chemically synthesized
ttcaggggctttgaccattttt

SEQ ID NO: 1409498 - DNA, 22 bp, Artificial Sequence
  chemically synthesized
aggggctttgaccatttttaat

SEQ ID NO: 1409499 - DNA, 22 bp, Artificial Sequence
  chemically synthesized
tgaccatttttaatcagatttt

SEQ ID NO: 1409500 - DNA, 22 bp, Artificial Sequence
  chemically synthesized
gaccatttttaatcagattttt

SEQ ID NO: 1409501 - DNA, 22 bp, Artificial Sequence
  chemically synthesized
accatttttaatcagatttttt

SEQ ID NO: 1409502 - DNA, 22 bp, Artificial Sequence
  chemically synthesized
ttaatcagattttttgtttttt

SEQ ID NO: 1409503 - DNA, 22 bp, Artificial Sequence
  chemically synthesized
taatcagattttttgttttttg

SEQ ID NO: 1409504 - DNA, 22 bp, Artificial Sequence
  chemically synthesized
aatcagattttttgttttttgt

SEQ ID NO: 1409505 - DNA, 22 bp, Artificial Sequence
  chemically synthesized
atcagattttttgttttttgtt

SEQ ID NO: 1409506 - DNA, 22 bp, Artificial Sequence
  chemically synthesized
aagcaaaacacacaaacaaaaa

SEQ ID NO: 1409507 - DNA, 22 bp, Artificial Sequence
  chemically synthesized
tttgttttttgtttgtgtgttt

SEQ ID NO: 1409508 - DNA, 22 bp, Artificial Sequence
  chemically synthesized
agagctcaagcaaaacacacaa

SEQ ID NO: 1409509 - DNA, 22 bp, Artificial Sequence
  chemically synthesized
ttgttttttgtttgtgtgtttt

SEQ ID NO: 1409510 - DNA, 22 bp, Artificial Sequence
  chemically synthesized
tgttttttgtttgtgtgttttg

SEQ ID NO: 1409511 - DNA, 22 bp, Artificial Sequence
  chemically synthesized
gttttttgtttgtgtgttttgc

SEQ ID NO: 1409512 - DNA, 22 bp, Artificial Sequence
  chemically synthesized
ttttttgtttgtgtgttttgct

SEQ ID NO: 1409513 - DNA, 22 bp, Artificial Sequence
  chemically synthesized
tttgtttgtgtgttttgcttga

SEQ ID NO: 1409514 - DNA, 22 bp, Artificial Sequence
  chemically synthesized
ttgtttgtgtgttttgcttgag

SEQ ID NO: 1409515 - DNA, 22 bp, Artificial Sequence
  chemically synthesized
tgtttgtgtgttttgcttgagc

SEQ ID NO: 1409516 - DNA, 22 bp, Artificial Sequence
  chemically synthesized
gtttgtgtgttttgcttgagct

SEQ ID NO: 1409517 - DNA, 22 bp, Artificial Sequence
  chemically synthesized
tttgtgtgttttgcttgagctc

SEQ ID NO: 1409518 - DNA, 22 bp, Artificial Sequence
  chemically synthesized
gtgtgttttgcttgagctctga

SEQ ID NO: 1409519 - DNA, 22 bp, Artificial Sequence
  chemically synthesized
tgtgttttgcttgagctctgag

SEQ ID NO: 1409520 - DNA, 22 bp, Artificial Sequence
  chemically synthesized
tgcttgagctctgagttcctca

SEQ ID NO: 1409521 - DNA, 22 bp, Artificial Sequence
  chemically synthesized
atccaaaatatatgaggaactc

SEQ ID NO: 1409522 - DNA, 22 bp, Artificial Sequence
  chemically synthesized
gcttgagctctgagttcctcat

SEQ ID NO: 1409523 - DNA, 22 bp, Artificial Sequence
  chemically synthesized
catccaaaatatatgaggaact

SEQ ID NO: 1409524 - DNA, 22 bp, Artificial Sequence
  chemically synthesized
cttgagctctgagttcctcata

SEQ ID NO: 1409525 - DNA, 22 bp, Artificial Sequence
  chemically synthesized
tcatccaaaatatatgaggaac

SEQ ID NO: 1409526 - DNA, 22 bp, Artificial Sequence
  chemically synthesized
gagctctgagttcctcatatat

SEQ ID NO: 1409527 - DNA, 22 bp, Artificial Sequence
  chemically synthesized
agctctgagttcctcatatatt

SEQ ID NO: 1409528 - DNA, 22 bp, Artificial Sequence
  chemically synthesized
tgagttcctcatatattttgga

SEQ ID NO: 1409529 - DNA, 22 bp, Artificial Sequence
  chemically synthesized
agttcctcatatattttggatg

SEQ ID NO: 1409530 - DNA, 22 bp, Artificial Sequence
  chemically synthesized
ctcatatattttggatgaaagc

SEQ ID NO: 1409531 - DNA, 22 bp, Artificial Sequence
  chemically synthesized
atatattttggatgaaagctgc

SEQ ID NO: 1409532 - DNA, 22 bp, Artificial Sequence
  chemically synthesized
tggatgaaagctgcatattggt

SEQ ID NO: 1409533 - DNA, 22 bp, Artificial Sequence
  chemically synthesized
gcaaaccatatgaccaatatgc

SEQ ID NO: 1409534 - DNA, 22 bp, Artificial Sequence
  chemically synthesized
ggatgaaagctgcatattggtc

SEQ ID NO: 1409535 - DNA, 22 bp, Artificial Sequence
  chemically synthesized
gatgaaagctgcatattggtca

SEQ ID NO: 1409536 - DNA, 22 bp, Artificial Sequence
  chemically synthesized
catattggtcatatggtttgct

SEQ ID NO: 1409537 - DNA, 22 bp, Artificial Sequence
  chemically synthesized
gtcatatggtttgctaatatat

SEQ ID NO: 1409538 - DNA, 22 bp, Artificial Sequence
  chemically synthesized
tggaatgggagaatatattagc

SEQ ID NO: 1409539 - DNA, 22 bp, Artificial Sequence
  chemically synthesized
gctaatatattctcccattcca

SEQ ID NO: 1409540 - DNA, 22 bp, Artificial Sequence
  chemically synthesized
ctaatatattctcccattccac

SEQ ID NO: 1409541 - DNA, 22 bp, Artificial Sequence
  chemically synthesized
atatattctcccattccacagt

SEQ ID NO: 1409542 - DNA, 22 bp, Artificial Sequence
  chemically synthesized
acagagtgaagagacaactgtg

SEQ ID NO: 1409543 - DNA, 22 bp, Artificial Sequence
  chemically synthesized
tcccattccacagttgtctctt

SEQ ID NO: 1409544 - DNA, 22 bp, Artificial Sequence
  chemically synthesized
ccattccacagttgtctcttca

SEQ ID NO: 1409545 - DNA, 22 bp, Artificial Sequence
  chemically synthesized
cacagttgtctcttcactctgt

SEQ ID NO: 1409546 - DNA, 22 bp, Artificial Sequence
  chemically synthesized
tctcttcactctgttaattgtt

SEQ ID NO: 1409547 - DNA, 22 bp, Artificial Sequence
  chemically synthesized
tacagcataggaaacaattaac

SEQ ID NO: 1409548 - DNA, 22 bp, Artificial Sequence
  chemically synthesized
tgtacagcataggaaacaatta

SEQ ID NO: 1409549 - DNA, 22 bp, Artificial Sequence
  chemically synthesized
ctgtacagcataggaaacaatt

SEQ ID NO: 1409550 - DNA, 22 bp, Artificial Sequence
  chemically synthesized
ttcactctgttaattgtttcct

SEQ ID NO: 1409551 - DNA, 22 bp, Artificial Sequence
  chemically synthesized
cactctgttaattgtttcctat

SEQ ID NO: 1409552 - DNA, 22 bp, Artificial Sequence
  chemically synthesized
actctgttaattgtttcctatg

SEQ ID NO: 1409553 - DNA, 22 bp, Artificial Sequence
  chemically synthesized
tgttaattgtttcctatgctgt

SEQ ID NO: 1409554 - DNA, 22 bp, Artificial Sequence
  chemically synthesized
ttaattgtttcctatgctgtac

SEQ ID NO: 1409555 - DNA, 22 bp, Artificial Sequence
  chemically synthesized
attgtttcctatgctgtacaga

SEQ ID NO: 1409556 - DNA, 22 bp, Artificial Sequence
  chemically synthesized
tttcctatgctgtacagaaggt

SEQ ID NO: 1409557 - DNA, 22 bp, Artificial Sequence
  chemically synthesized
cggcaaaccataaaccttctgt

SEQ ID NO: 1409558 - DNA, 22 bp, Artificial Sequence
  chemically synthesized
cctatgctgtacagaaggttta

SEQ ID NO: 1409559 - DNA, 22 bp, Artificial Sequence
  chemically synthesized
ctatgctgtacagaaggtttat

SEQ ID NO: 1409560 - DNA, 22 bp, Artificial Sequence
  chemically synthesized
tactacggcaaaccataaacct

SEQ ID NO: 1409561 - DNA, 22 bp, Artificial Sequence
  chemically synthesized
tgctgtacagaaggtttatggt

SEQ ID NO: 1409562 - DNA, 22 bp, Artificial Sequence
  chemically synthesized
tacagaaggtttatggtttgcc

SEQ ID NO: 1409563 - DNA, 22 bp, Artificial Sequence
  chemically synthesized
aacaagttgtactacggcaaac

SEQ ID NO: 1409564 - DNA, 22 bp, Artificial Sequence
  chemically synthesized
atggtttgccgtagtacaactt

SEQ ID NO: 1409565 - DNA, 22 bp, Artificial Sequence
  chemically synthesized
tggtttgccgtagtacaacttg

SEQ ID NO: 1409566 - DNA, 22 bp, Artificial Sequence
  chemically synthesized
gccgtagtacaacttgtttaat

SEQ ID NO: 1409567 - DNA, 22 bp, Artificial Sequence
  chemically synthesized
ccgtagtacaacttgtttaatt

SEQ ID NO: 1409568 - DNA, 22 bp, Artificial Sequence
  chemically synthesized
gtttaattttgattttactgtc

SEQ ID NO: 1409569 - DNA, 22 bp, Artificial Sequence
  chemically synthesized
tttaattttgattttactgtct

SEQ ID NO: 1409570 - DNA, 22 bp, Artificial Sequence
  chemically synthesized
aattttgattttactgtctgtg

SEQ ID NO: 1409571 - DNA, 22 bp, Artificial Sequence
  chemically synthesized
attttgattttactgtctgtgc

SEQ ID NO: 1409572 - DNA, 22 bp, Artificial Sequence
  chemically synthesized
gatatgacatgaaaagcacaga

SEQ ID NO: 1409573 - DNA, 22 bp, Artificial Sequence
  chemically synthesized
tgattttactgtctgtgctttt

SEQ ID NO: 1409574 - DNA, 22 bp, Artificial Sequence
  chemically synthesized
agatatgacatgaaaagcacag

SEQ ID NO: 1409575 - DNA, 22 bp, Artificial Sequence
  chemically synthesized
gattttactgtctgtgcttttc

SEQ ID NO: 1409576 - DNA, 22 bp, Artificial Sequence
  chemically synthesized
tagatatgacatgaaaagcaca

SEQ ID NO: 1409577 - DNA, 22 bp, Artificial Sequence
  chemically synthesized
attttactgtctgtgcttttca

SEQ ID NO: 1409578 - DNA, 22 bp, Artificial Sequence
  chemically synthesized
ttagatatgacatgaaaagcac

SEQ ID NO: 1409579 - DNA, 22 bp, Artificial Sequence
  chemically synthesized
tttagatatgacatgaaaagca

SEQ ID NO: 1409580 - DNA, 22 bp, Artificial Sequence
  chemically synthesized
tactgtctgtgcttttcatgtc

SEQ ID NO: 1409581 - DNA, 22 bp, Artificial Sequence
  chemically synthesized
actgtctgtgcttttcatgtca

SEQ ID NO: 1409582 - DNA, 22 bp, Artificial Sequence
  chemically synthesized
ctgtctgtgcttttcatgtcat

SEQ ID NO: 1409583 - DNA, 22 bp, Artificial Sequence
  chemically synthesized
tctgtgcttttcatgtcatatc

SEQ ID NO: 1409584 - DNA, 22 bp, Artificial Sequence
  chemically synthesized
gcaatgattttttagatatgac

SEQ ID NO: 1409585 - DNA, 22 bp, Artificial Sequence
  chemically synthesized
ggcaatgattttttagatatga

SEQ ID NO: 1409586 - DNA, 22 bp, Artificial Sequence
  chemically synthesized
tgcttttcatgtcatatctaaa

SEQ ID NO: 1409587 - DNA, 22 bp, Artificial Sequence
  chemically synthesized
gtcttggcaatgattttttaga

SEQ ID NO: 1409588 - DNA, 22 bp, Artificial Sequence
  chemically synthesized
ttcatgtcatatctaaaaaatc

SEQ ID NO: 1409589 - DNA, 22 bp, Artificial Sequence
  chemically synthesized
tcatgtcatatctaaaaaatca

SEQ ID NO: 1409590 - DNA, 22 bp, Artificial Sequence
  chemically synthesized
catgtcatatctaaaaaatcat

SEQ ID NO: 1409591 - DNA, 22 bp, Artificial Sequence
  chemically synthesized
atgtcatatctaaaaaatcatt

SEQ ID NO: 1409592 - DNA, 22 bp, Artificial Sequence
  chemically synthesized
gaaattggtcttggcaatgatt

SEQ ID NO: 1409593 - DNA, 22 bp, Artificial Sequence
  chemically synthesized
tcgaaattggtcttggcaatga

SEQ ID NO: 1409594 - DNA, 22 bp, Artificial Sequence
  chemically synthesized
aaaaatcattgccaagaccaat

SEQ ID NO: 1409595 - DNA, 22 bp, Artificial Sequence
  chemically synthesized
ccaagaccaatttcgagaattt

SEQ ID NO: 1409596 - DNA, 22 bp, Artificial Sequence
  chemically synthesized
gaagaaagtgcatgaaaaaata

SEQ ID NO: 1409597 - DNA, 22 bp, Artificial Sequence
  chemically synthesized
ctagaagaaagtgcatgaaaaa

SEQ ID NO: 1409598 - DNA, 22 bp, Artificial Sequence
  chemically synthesized
cgagaatttattttttcatgca

SEQ ID NO: 1409599 - DNA, 22 bp, Artificial Sequence
  chemically synthesized
gagaatttattttttcatgcac

SEQ ID NO: 1409600 - DNA, 22 bp, Artificial Sequence
  chemically synthesized
caaaattcctagaagaaagtgc

SEQ ID NO: 1409601 - DNA, 22 bp, Artificial Sequence
  chemically synthesized
attttttcatgcactttcttct

SEQ ID NO: 1409602 - DNA, 22 bp, Artificial Sequence
  chemically synthesized
ttttttcatgcactttcttcta

SEQ ID NO: 1409603 - DNA, 22 bp, Artificial Sequence
  chemically synthesized
tttcatgcactttcttctagga

SEQ ID NO: 1409604 - DNA, 22 bp, Artificial Sequence
  chemically synthesized
aaactacaaaattcctagaaga

SEQ ID NO: 1409605 - DNA, 22 bp, Artificial Sequence
  chemically synthesized
ttcatgcactttcttctaggaa

SEQ ID NO: 1409606 - DNA, 22 bp, Artificial Sequence
  chemically synthesized
tcatgcactttcttctaggaat

SEQ ID NO: 1409607 - DNA, 22 bp, Artificial Sequence
  chemically synthesized
catgcactttcttctaggaatt

SEQ ID NO: 1409608 - DNA, 22 bp, Artificial Sequence
  chemically synthesized
atgcactttcttctaggaattt

SEQ ID NO: 1409609 - DNA, 22 bp, Artificial Sequence
  chemically synthesized
tcttctaggaattttgtagttt

SEQ ID NO: 1409610 - DNA, 22 bp, Artificial Sequence
  chemically synthesized
cttctaggaattttgtagtttc

SEQ ID NO: 1409611 - DNA, 22 bp, Artificial Sequence
  chemically synthesized
aatgtaagacctgaaactacaa

SEQ ID NO: 1409612 - DNA, 22 bp, Artificial Sequence
  chemically synthesized
ttctaggaattttgtagtttca

SEQ ID NO: 1409613 - DNA, 22 bp, Artificial Sequence
  chemically synthesized
ctaggaattttgtagtttcagg

SEQ ID NO: 1409614 - DNA, 22 bp, Artificial Sequence
  chemically synthesized
taggaattttgtagtttcaggt

SEQ ID NO: 1409615 - DNA, 22 bp, Artificial Sequence
  chemically synthesized
ggaattttgtagtttcaggtct

SEQ ID NO: 1409616 - DNA, 22 bp, Artificial Sequence
  chemically synthesized
aagaattaaatgtaagacctga

SEQ ID NO: 1409617 - DNA, 22 bp, Artificial Sequence
  chemically synthesized
attaaagaattaaatgtaagac

SEQ ID NO: 1409618 - DNA, 22 bp, Artificial Sequence
  chemically synthesized
tgtagtttcaggtcttacattt

SEQ ID NO: 1409619 - DNA, 22 bp, Artificial Sequence
  chemically synthesized
gtagtttcaggtcttacattta

SEQ ID NO: 1409620 - DNA, 22 bp, Artificial Sequence
  chemically synthesized
tagtttcaggtcttacatttaa

SEQ ID NO: 1409621 - DNA, 22 bp, Artificial Sequence
  chemically synthesized
aaaattgattaaagaattaaat

SEQ ID NO: 1409622 - DNA, 22 bp, Artificial Sequence
  chemically synthesized
caggtcttacatttaattcttt

SEQ ID NO: 1409623 - DNA, 22 bp, Artificial Sequence
  chemically synthesized
aggtcttacatttaattcttta

SEQ ID NO: 1409624 - DNA, 22 bp, Artificial Sequence
  chemically synthesized
acatttaattctttaatcaatt

SEQ ID NO: 1409625 - DNA, 22 bp, Artificial Sequence
  chemically synthesized
catttaattctttaatcaattt

SEQ ID NO: 1409626 - DNA, 22 bp, Artificial Sequence
  chemically synthesized
aattctttaatcaatttttagc

SEQ ID NO: 1409627 - DNA, 22 bp, Artificial Sequence
  chemically synthesized
attctttaatcaatttttagct

SEQ ID NO: 1409628 - DNA, 22 bp, Artificial Sequence
  chemically synthesized
tttaatcaatttttagctgact

SEQ ID NO: 1409629 - DNA, 22 bp, Artificial Sequence
  chemically synthesized
taatcaatttttagctgacttt

SEQ ID NO: 1409630 - DNA, 22 bp, Artificial Sequence
  chemically synthesized
catcacacaacaaaagtcagct

SEQ ID NO: 1409631 - DNA, 22 bp, Artificial Sequence
  chemically synthesized
aatcaatttttagctgactttt

SEQ ID NO: 1409632 - DNA, 22 bp, Artificial Sequence
  chemically synthesized
acatcacacaacaaaagtcagc

SEQ ID NO: 1409633 - DNA, 22 bp, Artificial Sequence
  chemically synthesized
atcaatttttagctgacttttg

SEQ ID NO: 1409634 - DNA, 22 bp, Artificial Sequence
  chemically synthesized
gacccttacatcacacaacaaa

SEQ ID NO: 1409635 - DNA, 22 bp, Artificial Sequence
  chemically synthesized
ttagctgacttttgttgtgtga

SEQ ID NO: 1409636 - DNA, 22 bp, Artificial Sequence
  chemically synthesized
tagctgacttttgttgtgtgat

SEQ ID NO: 1409637 - DNA, 22 bp, Artificial Sequence
  chemically synthesized
agctgacttttgttgtgtgatg

SEQ ID NO: 1409638 - DNA, 22 bp, Artificial Sequence
  chemically synthesized
gctgacttttgttgtgtgatgt

SEQ ID NO: 1409639 - DNA, 22 bp, Artificial Sequence
  chemically synthesized
acttttgttgtgtgatgtaagg

SEQ ID NO: 1409640 - DNA, 22 bp, Artificial Sequence
  chemically synthesized
ttgttgtgtgatgtaagggtcc

SEQ ID NO: 1409641 - DNA, 22 bp, Artificial Sequence
  chemically synthesized
aagaataaaattggacccttac

SEQ ID NO: 1409642 - DNA, 22 bp, Artificial Sequence
  chemically synthesized
tgttgtgtgatgtaagggtcca

SEQ ID NO: 1409643 - DNA, 22 bp, Artificial Sequence
  chemically synthesized
gttgtgtgatgtaagggtccaa

SEQ ID NO: 1409644 - DNA, 22 bp, Artificial Sequence
  chemically synthesized
ttgtgtgatgtaagggtccaat

SEQ ID NO: 1409645 - DNA, 22 bp, Artificial Sequence
  chemically synthesized
tgtgatgtaagggtccaatttt

SEQ ID NO: 1409646 - DNA, 22 bp, Artificial Sequence
  chemically synthesized
gatatacacatgctaaagaata

SEQ ID NO: 1409647 - DNA, 22 bp, Artificial Sequence
  chemically synthesized
aaaaactggatatacacatgct

SEQ ID NO: 1409648 - DNA, 22 bp, Artificial Sequence
  chemically synthesized
gaaaaactggatatacacatgc

SEQ ID NO: 1409649 - DNA, 22 bp, Artificial Sequence
  chemically synthesized
tattctttagcatgtgtatatc

SEQ ID NO: 1409650 - DNA, 22 bp, Artificial Sequence
  chemically synthesized
attctttagcatgtgtatatcc

SEQ ID NO: 1409651 - DNA, 22 bp, Artificial Sequence
  chemically synthesized
ttctttagcatgtgtatatcca

SEQ ID NO: 1409652 - DNA, 22 bp, Artificial Sequence
  chemically synthesized
tttagcatgtgtatatccagtt

SEQ ID NO: 1409653 - DNA, 22 bp, Artificial Sequence
  chemically synthesized
tagcatgtgtatatccagtttt

SEQ ID NO: 1409654 - DNA, 22 bp, Artificial Sequence
  chemically synthesized
agcatgtgtatatccagttttt

SEQ ID NO: 1409655 - DNA, 22 bp, Artificial Sequence
  chemically synthesized
gcatgtgtatatccagtttttc

SEQ ID NO: 1409656 - DNA, 22 bp, Artificial Sequence
  chemically synthesized
ataaatggtgtttgaaaaactg

SEQ ID NO: 1409657 - DNA, 22 bp, Artificial Sequence
  chemically synthesized
aataaatggtgtttgaaaaact

SEQ ID NO: 1409658 - DNA, 22 bp, Artificial Sequence
  chemically synthesized
taataaatggtgtttgaaaaac

SEQ ID NO: 1409659 - DNA, 22 bp, Artificial Sequence
  chemically synthesized
tttaataaatggtgtttgaaaa

SEQ ID NO: 1409660 - DNA, 22 bp, Artificial Sequence
  chemically synthesized
tctttaataaatggtgtttgaa

SEQ ID NO: 1409661 - DNA, 22 bp, Artificial Sequence
  chemically synthesized
ttcaaacaccatttattaaaga

SEQ ID NO: 1409662 - DNA, 22 bp, Artificial Sequence
  chemically synthesized
tcaaacaccatttattaaagag

SEQ ID NO: 1409663 - DNA, 22 bp, Artificial Sequence
  chemically synthesized
caaacaccatttattaaagaga

SEQ ID NO: 1409664 - DNA, 22 bp, Artificial Sequence
  chemically synthesized
aaacaccatttattaaagagaa

SEQ ID NO: 1409665 - DNA, 22 bp, Artificial Sequence
  chemically synthesized
tgaggaaaggatattctcttta

SEQ ID NO: 1409666 - DNA, 22 bp, Artificial Sequence
  chemically synthesized
attaaagagaatatcctttcct

SEQ ID NO: 1409667 - DNA, 22 bp, Artificial Sequence
  chemically synthesized
ttaaagagaatatcctttcctc

SEQ ID NO: 1409668 - DNA, 22 bp, Artificial Sequence
  chemically synthesized
aagagaatatcctttcctcata

SEQ ID NO: 1409669 - DNA, 22 bp, Artificial Sequence
  chemically synthesized
agaagggcaacaagagtacact

SEQ ID NO: 1409670 - DNA, 22 bp, Artificial Sequence
  chemically synthesized
gagaagggcaacaagagtacac

SEQ ID NO: 1409671 - DNA, 22 bp, Artificial Sequence
  chemically synthesized
tgagaagggcaacaagagtaca

SEQ ID NO: 1409672 - DNA, 22 bp, Artificial Sequence
  chemically synthesized
tcctcatagtgtactcttgttg

SEQ ID NO: 1409673 - DNA, 22 bp, Artificial Sequence
  chemically synthesized
cctcatagtgtactcttgttgc

SEQ ID NO: 1409674 - DNA, 22 bp, Artificial Sequence
  chemically synthesized
ctcatagtgtactcttgttgcc

SEQ ID NO: 1409675 - DNA, 22 bp, Artificial Sequence
  chemically synthesized
aattttgagaagggcaacaaga

SEQ ID NO: 1409676 - DNA, 22 bp, Artificial Sequence
  chemically synthesized
atagtgtactcttgttgccctt

SEQ ID NO: 1409677 - DNA, 22 bp, Artificial Sequence
  chemically synthesized
ttgttgcccttctcaaaattta

SEQ ID NO: 1409678 - DNA, 22 bp, Artificial Sequence
  chemically synthesized
atatatggtcaactaaattttg

SEQ ID NO: 1409679 - DNA, 22 bp, Artificial Sequence
  chemically synthesized
gttgcccttctcaaaatttagt

SEQ ID NO: 1409680 - DNA, 22 bp, Artificial Sequence
  chemically synthesized
ttgcccttctcaaaatttagtt

SEQ ID NO: 1409681 - DNA, 22 bp, Artificial Sequence
  chemically synthesized
cccttctcaaaatttagttgac

SEQ ID NO: 1409682 - DNA, 22 bp, Artificial Sequence
  chemically synthesized
ctcaaaatttagttgaccatat

SEQ ID NO: 1409683 - DNA, 22 bp, Artificial Sequence
  chemically synthesized
tcaaaatttagttgaccatata

SEQ ID NO: 1409684 - DNA, 22 bp, Artificial Sequence
  chemically synthesized
aaaatttagttgaccatatatg

SEQ ID NO: 1409685 - DNA, 22 bp, Artificial Sequence
  chemically synthesized
agttgaccatatatgaatgggt

SEQ ID NO: 1409686 - DNA, 22 bp, Artificial Sequence
  chemically synthesized
gttgaccatatatgaatgggtt

SEQ ID NO: 1409687 - DNA, 22 bp, Artificial Sequence
  chemically synthesized
accatatatgaatgggtttatt

SEQ ID NO: 1409688 - DNA, 22 bp, Artificial Sequence
  chemically synthesized
atttatgggccctccattctgt

SEQ ID NO: 1409689 - DNA, 22 bp, Artificial Sequence
  chemically synthesized
tttatgggccctccattctgtt

SEQ ID NO: 1409690 - DNA, 22 bp, Artificial Sequence
  chemically synthesized
atgggccctccattctgttgca

SEQ ID NO: 1409691 - DNA, 22 bp, Artificial Sequence
  chemically synthesized
tgggccctccattctgttgcat

SEQ ID NO: 1409692 - DNA, 22 bp, Artificial Sequence
  chemically synthesized
cattctgttgcattggtctata

SEQ ID NO: 1409693 - DNA, 22 bp, Artificial Sequence
  chemically synthesized
gcataaaagcagacatatagac

SEQ ID NO: 1409694 - DNA, 22 bp, Artificial Sequence
  chemically synthesized
tgttgcattggtctatatgtct

SEQ ID NO: 1409695 - DNA, 22 bp, Artificial Sequence
  chemically synthesized
ttgcattggtctatatgtctgc

SEQ ID NO: 1409696 - DNA, 22 bp, Artificial Sequence
  chemically synthesized
cattggtctatatgtctgcttt

SEQ ID NO: 1409697 - DNA, 22 bp, Artificial Sequence
  chemically synthesized
gtctatatgtctgcttttatgc

SEQ ID NO: 1409698 - DNA, 22 bp, Artificial Sequence
  chemically synthesized
tatgtctgcttttatgccagta

SEQ ID NO: 1409699 - DNA, 22 bp, Artificial Sequence
  chemically synthesized
gtaatcaaaataatatagtact

SEQ ID NO: 1409700 - DNA, 22 bp, Artificial Sequence
  chemically synthesized
agtaatcaaaataatatagtac

SEQ ID NO: 1409701 - DNA, 22 bp, Artificial Sequence
  chemically synthesized
cttttatgccagtactatatta

SEQ ID NO: 1409702 - DNA, 22 bp, Artificial Sequence
  chemically synthesized
tagtaatcaaaataatatagta

SEQ ID NO: 1409703 - DNA, 22 bp, Artificial Sequence
  chemically synthesized
ttatgccagtactatattattt

SEQ ID NO: 1409704 - DNA, 22 bp, Artificial Sequence
  chemically synthesized
tatgccagtactatattatttt

SEQ ID NO: 1409705 - DNA, 22 bp, Artificial Sequence
  chemically synthesized
atgccagtactatattattttg

SEQ ID NO: 1409706 - DNA, 22 bp, Artificial Sequence
  chemically synthesized
tgccagtactatattattttga

SEQ ID NO: 1409707 - DNA, 22 bp, Artificial Sequence
  chemically synthesized
tatgacaaagctttagtaatca

SEQ ID NO: 1409708 - DNA, 22 bp, Artificial Sequence
  chemically synthesized
tattattttgattactaaagct

SEQ ID NO: 1409709 - DNA, 22 bp, Artificial Sequence
  chemically synthesized
aattatatgacaaagctttagt

SEQ ID NO: 1409710 - DNA, 22 bp, Artificial Sequence
  chemically synthesized
gaattatatgacaaagctttag

SEQ ID NO: 1409711 - DNA, 22 bp, Artificial Sequence
  chemically synthesized
tgaattatatgacaaagcttta

SEQ ID NO: 1409712 - DNA, 22 bp, Artificial Sequence
  chemically synthesized
ttttgattactaaagctttgtc

SEQ ID NO: 1409713 - DNA, 22 bp, Artificial Sequence
  chemically synthesized
attttgaattatatgacaaagc

SEQ ID NO: 1409714 - DNA, 22 bp, Artificial Sequence
  chemically synthesized
tgattactaaagctttgtcata

SEQ ID NO: 1409715 - DNA, 22 bp, Artificial Sequence
  chemically synthesized
gattactaaagctttgtcatat

SEQ ID NO: 1409716 - DNA, 22 bp, Artificial Sequence
  chemically synthesized
attactaaagctttgtcatata

SEQ ID NO: 1409717 - DNA, 22 bp, Artificial Sequence
  chemically synthesized
ctgattttgaattatatgacaa

SEQ ID NO: 1409718 - DNA, 22 bp, Artificial Sequence
  chemically synthesized
cctgattttgaattatatgaca

SEQ ID NO: 1409719 - DNA, 22 bp, Artificial Sequence
  chemically synthesized
ctaaagctttgtcatataattc

SEQ ID NO: 1409720 - DNA, 22 bp, Artificial Sequence
  chemically synthesized
aagctttgtcatataattcaaa

SEQ ID NO: 1409721 - DNA, 22 bp, Artificial Sequence
  chemically synthesized
tgtcatataattcaaaatcagg

SEQ ID NO: 1409722 - DNA, 22 bp, Artificial Sequence
  chemically synthesized
gtcatataattcaaaatcagga

SEQ ID NO: 1409723 - DNA, 22 bp, Artificial Sequence
  chemically synthesized
tcatataattcaaaatcaggaa

SEQ ID NO: 1409724 - DNA, 22 bp, Artificial Sequence
  chemically synthesized
gaggtatcacacttcctgattt

SEQ ID NO: 1409725 - DNA, 22 bp, Artificial Sequence
  chemically synthesized
aaaatcaggaagtgtgatacct

SEQ ID NO: 1409726 - DNA, 22 bp, Artificial Sequence
  chemically synthesized
agaaggataagcaacattggag

SEQ ID NO: 1409727 - DNA, 22 bp, Artificial Sequence
  chemically synthesized
gagaaggataagcaacattgga

SEQ ID NO: 1409728 - DNA, 22 bp, Artificial Sequence
  chemically synthesized
caatgttgcttatccttctcaa

SEQ ID NO: 1409729 - DNA, 22 bp, Artificial Sequence
  chemically synthesized
cttatccttctcaagattgctt

SEQ ID NO: 1409730 - DNA, 22 bp, Artificial Sequence
  chemically synthesized
atccttctcaagattgctttgg

SEQ ID NO: 1409731 - DNA, 22 bp, Artificial Sequence
  chemically synthesized
tccttctcaagattgctttggc

SEQ ID NO: 1409732 - DNA, 22 bp, Artificial Sequence
  chemically synthesized
ctcaagattgctttggctattc

SEQ ID NO: 1409733 - DNA, 22 bp, Artificial Sequence
  chemically synthesized
tcaagattgctttggctattct

SEQ ID NO: 1409734 - DNA, 22 bp, Artificial Sequence
  chemically synthesized
aagattgctttggctattctct

SEQ ID NO: 1409735 - DNA, 22 bp, Artificial Sequence
  chemically synthesized
ctttggctattctctttctttt

SEQ ID NO: 1409736 - DNA, 22 bp, Artificial Sequence
  chemically synthesized
aaatgaaacaacaaaagaaaga

SEQ ID NO: 1409737 - DNA, 22 bp, Artificial Sequence
  chemically synthesized
tggctattctctttcttttgtt

SEQ ID NO: 1409738 - DNA, 22 bp, Artificial Sequence
  chemically synthesized
ggctattctctttcttttgttg

SEQ ID NO: 1409739 - DNA, 22 bp, Artificial Sequence
  chemically synthesized
gctattctctttcttttgttgt

SEQ ID NO: 1409740 - DNA, 22 bp, Artificial Sequence
  chemically synthesized
aaattcaaatgaaacaacaaaa

SEQ ID NO: 1409741 - DNA, 22 bp, Artificial Sequence
  chemically synthesized
ttctctttcttttgttgtttca

SEQ ID NO: 1409742 - DNA, 22 bp, Artificial Sequence
  chemically synthesized
tctttcttttgttgtttcattt

SEQ ID NO: 1409743 - DNA, 22 bp, Artificial Sequence
  chemically synthesized
tttcttttgttgtttcatttga

SEQ ID NO: 1409744 - DNA, 22 bp, Artificial Sequence
  chemically synthesized
tcttttgttgtttcatttgaat

SEQ ID NO: 1409745 - DNA, 22 bp, Artificial Sequence
  chemically synthesized
cttttgttgtttcatttgaatt

SEQ ID NO: 1409746 - DNA, 22 bp, Artificial Sequence
  chemically synthesized
aaaaaaatctaaaattcaaatg

SEQ ID NO: 1409747 - DNA, 22 bp, Artificial Sequence
  chemically synthesized
ttttgttgtttcatttgaattt

SEQ ID NO: 1409748 - DNA, 22 bp, Artificial Sequence
  chemically synthesized
aaaaaaaatctaaaattcaaat

SEQ ID NO: 1409749 - DNA, 22 bp, Artificial Sequence
  chemically synthesized
ttgttgtttcatttgaatttta

SEQ ID NO: 1409750 - DNA, 22 bp, Artificial Sequence
  chemically synthesized
tgttgtttcatttgaattttag

SEQ ID NO: 1409751 - DNA, 22 bp, Artificial Sequence
  chemically synthesized
gttgtttcatttgaattttaga

SEQ ID NO: 1409752 - DNA, 22 bp, Artificial Sequence
  chemically synthesized
ttgtttcatttgaattttagat

SEQ ID NO: 1409753 - DNA, 22 bp, Artificial Sequence
  chemically synthesized
tttcatttgaattttagatttt

SEQ ID NO: 1409754 - DNA, 22 bp, Artificial Sequence
  chemically synthesized
atagatttaaaaaaaatctaaa

SEQ ID NO: 1409755 - DNA, 22 bp, Artificial Sequence
  chemically synthesized
catagatttaaaaaaaatctaa

SEQ ID NO: 1409756 - DNA, 22 bp, Artificial Sequence
  chemically synthesized
tcatagatttaaaaaaaatcta

SEQ ID NO: 1409757 - DNA, 22 bp, Artificial Sequence
  chemically synthesized
catttgaattttagattttttt

SEQ ID NO: 1409758 - DNA, 22 bp, Artificial Sequence
  chemically synthesized
ttcatagatttaaaaaaaatct

SEQ ID NO: 1409759 - DNA, 22 bp, Artificial Sequence
  chemically synthesized
atttgaattttagatttttttt

SEQ ID NO: 1409760 - DNA, 22 bp, Artificial Sequence
  chemically synthesized
gaattttagattttttttaaat

SEQ ID NO: 1409761 - DNA, 22 bp, Artificial Sequence
  chemically synthesized
aattttagattttttttaaatc

SEQ ID NO: 1409762 - DNA, 22 bp, Artificial Sequence
  chemically synthesized
tagattttttttaaatctatga

SEQ ID NO: 1409763 - DNA, 22 bp, Artificial Sequence
  chemically synthesized
agattttttttaaatctatgaa

SEQ ID NO: 1409764 - DNA, 22 bp, Artificial Sequence
  chemically synthesized
gattttttttaaatctatgaaa

SEQ ID NO: 1409765 - DNA, 22 bp, Artificial Sequence
  chemically synthesized
tttttaaatctatgaaaaatgc

SEQ ID NO: 1409766 - DNA, 22 bp, Artificial Sequence
  chemically synthesized
ttttaaatctatgaaaaatgct

SEQ ID NO: 1409767 - DNA, 22 bp, Artificial Sequence
  chemically synthesized
tttaaatctatgaaaaatgcta

SEQ ID NO: 1409768 - DNA, 22 bp, Artificial Sequence
  chemically synthesized
tcaaaatgccaatagcattttt

SEQ ID NO: 1409769 - DNA, 22 bp, Artificial Sequence
  chemically synthesized
ttaaatctatgaaaaatgctat

SEQ ID NO: 1409770 - DNA, 22 bp, Artificial Sequence
  chemically synthesized
taaatctatgaaaaatgctatt

SEQ ID NO: 1409771 - DNA, 22 bp, Artificial Sequence
  chemically synthesized
tatcaaaatgccaatagcattt

SEQ ID NO: 1409772 - DNA, 22 bp, Artificial Sequence
  chemically synthesized
aaatctatgaaaaatgctattg

SEQ ID NO: 1409773 - DNA, 22 bp, Artificial Sequence
  chemically synthesized
aatctatgaaaaatgctattgg

SEQ ID NO: 1409774 - DNA, 22 bp, Artificial Sequence
  chemically synthesized
tgaaaaatgctattggcatttt

SEQ ID NO: 1409775 - DNA, 22 bp, Artificial Sequence
  chemically synthesized
agcacaacctctatcaaaatgc

SEQ ID NO: 1409776 - DNA, 22 bp, Artificial Sequence
  chemically synthesized
cagattcagcacaacctctatc

SEQ ID NO: 1409777 - DNA, 22 bp, Artificial Sequence
  chemically synthesized
acagattcagcacaacctctat

SEQ ID NO: 1409778 - DNA, 22 bp, Artificial Sequence
  chemically synthesized
ttggcattttgatagaggttgt

SEQ ID NO: 1409779 - DNA, 22 bp, Artificial Sequence
  chemically synthesized
gcattttgatagaggttgtgct

SEQ ID NO: 1409780 - DNA, 22 bp, Artificial Sequence
  chemically synthesized
tgatagaggttgtgctgaatct

SEQ ID NO: 1409781 - DNA, 22 bp, Artificial Sequence
  chemically synthesized
aaagcaatttacagattcagca

SEQ ID NO: 1409782 - DNA, 22 bp, Artificial Sequence
  chemically synthesized
gatagaggttgtgctgaatctg

SEQ ID NO: 1409783 - DNA, 22 bp, Artificial Sequence
  chemically synthesized
atagaggttgtgctgaatctgt

SEQ ID NO: 1409784 - DNA, 22 bp, Artificial Sequence
  chemically synthesized
ctcaaagcaatttacagattca

SEQ ID NO: 1409785 - DNA, 22 bp, Artificial Sequence
  chemically synthesized
tgctgaatctgtaaattgcttt

SEQ ID NO: 1409786 - DNA, 22 bp, Artificial Sequence
  chemically synthesized
aatctgtaaattgctttgagta

SEQ ID NO: 1409787 - DNA, 22 bp, Artificial Sequence
  chemically synthesized
aaatgtccatgctactcaaagc

SEQ ID NO: 1409788 - DNA, 22 bp, Artificial Sequence
  chemically synthesized
ttaaaatgtccatgctactcaa

SEQ ID NO: 1409789 - DNA, 22 bp, Artificial Sequence
  chemically synthesized
taaattgctttgagtagcatgg

SEQ ID NO: 1409790 - DNA, 22 bp, Artificial Sequence
  chemically synthesized
atattgttaaaatgtccatgct

SEQ ID NO: 1409791 - DNA, 22 bp, Artificial Sequence
  chemically synthesized
ctttgagtagcatggacatttt

SEQ ID NO: 1409792 - DNA, 22 bp, Artificial Sequence
  chemically synthesized
tgagtagcatggacattttaac

SEQ ID NO: 1409793 - DNA, 22 bp, Artificial Sequence
  chemically synthesized
gagtagcatggacattttaaca

SEQ ID NO: 1409794 - DNA, 22 bp, Artificial Sequence
  chemically synthesized
agtagcatggacattttaacaa

SEQ ID NO: 1409795 - DNA, 22 bp, Artificial Sequence
  chemically synthesized
gaaggattaatattgttaaaat

SEQ ID NO: 1409796 - DNA, 22 bp, Artificial Sequence
  chemically synthesized
atggactagaaggattaatatt

SEQ ID NO: 1409797 - DNA, 22 bp, Artificial Sequence
  chemically synthesized
tgttcatggactagaaggatta

SEQ ID NO: 1409798 - DNA, 22 bp, Artificial Sequence
  chemically synthesized
tgtgttcatggactagaaggat

SEQ ID NO: 1409799 - DNA, 22 bp, Artificial Sequence
  chemically synthesized
taacaatattaatccttctagt

SEQ ID NO: 1409800 - DNA, 22 bp, Artificial Sequence
  chemically synthesized
aacaatattaatccttctagtc

SEQ ID NO: 1409801 - DNA, 22 bp, Artificial Sequence
  chemically synthesized
acaatattaatccttctagtcc

SEQ ID NO: 1409802 - DNA, 22 bp, Artificial Sequence
  chemically synthesized
atccttctagtccatgaacaca

SEQ ID NO: 1409803 - DNA, 22 bp, Artificial Sequence
  chemically synthesized
ctagtccatgaacacagaacat

SEQ ID NO: 1409804 - DNA, 22 bp, Artificial Sequence
  chemically synthesized
tagtccatgaacacagaacata

SEQ ID NO: 1409805 - DNA, 22 bp, Artificial Sequence
  chemically synthesized
gtccatgaacacagaacataca

SEQ ID NO: 1409806 - DNA, 22 bp, Artificial Sequence
  chemically synthesized
aaagacgcaaataaatgggtgt

SEQ ID NO: 1409807 - DNA, 22 bp, Artificial Sequence
  chemically synthesized
aaaagacgcaaataaatgggtg

SEQ ID NO: 1409808 - DNA, 22 bp, Artificial Sequence
  chemically synthesized
taaaagacgcaaataaatgggt

SEQ ID NO: 1409809 - DNA, 22 bp, Artificial Sequence
  chemically synthesized
agaaattttaaaagacgcaaat

SEQ ID NO: 1409810 - DNA, 22 bp, Artificial Sequence
  chemically synthesized
aagaaattttaaaagacgcaaa

SEQ ID NO: 1409811 - DNA, 22 bp, Artificial Sequence
  chemically synthesized
atttaagaaattttaaaagacg

SEQ ID NO: 1409812 - DNA, 22 bp, Artificial Sequence
  chemically synthesized
atttgcgtcttttaaaatttct

SEQ ID NO: 1409813 - DNA, 22 bp, Artificial Sequence
  chemically synthesized
tttgcgtcttttaaaatttctt

SEQ ID NO: 1409814 - DNA, 22 bp, Artificial Sequence
  chemically synthesized
gcgtcttttaaaatttcttaaa

SEQ ID NO: 1409815 - DNA, 22 bp, Artificial Sequence
  chemically synthesized
cgtcttttaaaatttcttaaat

SEQ ID NO: 1409816 - DNA, 22 bp, Artificial Sequence
  chemically synthesized
ttaaaatttcttaaatcaggcc

SEQ ID NO: 1409817 - DNA, 22 bp, Artificial Sequence
  chemically synthesized
taaaatttcttaaatcaggcca

SEQ ID NO: 1409818 - DNA, 22 bp, Artificial Sequence
  chemically synthesized
aaaatttcttaaatcaggccac

SEQ ID NO: 1409819 - DNA, 22 bp, Artificial Sequence
  chemically synthesized
aaatttcttaaatcaggccacg

SEQ ID NO: 1409820 - DNA, 22 bp, Artificial Sequence
  chemically synthesized
cttaaatcaggccacgcacggt

SEQ ID NO: 1409821 - DNA, 22 bp, Artificial Sequence
  chemically synthesized
caggcatgagccaccgtgcgtg

SEQ ID NO: 1409822 - DNA, 22 bp, Artificial Sequence
  chemically synthesized
ttaaatcaggccacgcacggtg

SEQ ID NO: 1409823 - DNA, 22 bp, Artificial Sequence
  chemically synthesized
aaatcaggccacgcacggtggc

SEQ ID NO: 1409824 - DNA, 22 bp, Artificial Sequence
  chemically synthesized
aatcaggccacgcacggtggct

SEQ ID NO: 1409825 - DNA, 22 bp, Artificial Sequence
  chemically synthesized
ggattacaggcatgagccaccg

SEQ ID NO: 1409826 - DNA, 22 bp, Artificial Sequence
  chemically synthesized
acaaagtgctgggattacaggc

SEQ ID NO: 1409827 - DNA, 22 bp, Artificial Sequence
  chemically synthesized
ggcctcacaaagtgctgggatt

SEQ ID NO: 1409828 - DNA, 22 bp, Artificial Sequence
  chemically synthesized
atgcctgtaatcccagcacttt

SEQ ID NO: 1409829 - DNA, 22 bp, Artificial Sequence
  chemically synthesized
cctcggcctcacaaagtgctgg

SEQ ID NO: 1409830 - DNA, 22 bp, Artificial Sequence
  chemically synthesized
acctgcctcggcctcacaaagt

SEQ ID NO: 1409831 - DNA, 22 bp, Artificial Sequence
  chemically synthesized
taatcccagcactttgtgaggc

SEQ ID NO: 1409832 - DNA, 22 bp, Artificial Sequence
  chemically synthesized
aggtgattcacctgcctcggcc

SEQ ID NO: 1409833 - DNA, 22 bp, Artificial Sequence
  chemically synthesized
acctaaggtgattcacctgcct

SEQ ID NO: 1409834 - DNA, 22 bp, Artificial Sequence
  chemically synthesized
tgtgaggccgaggcaggtgaat

SEQ ID NO: 1409835 - DNA, 22 bp, Artificial Sequence
  chemically synthesized
gtgaggccgaggcaggtgaatc

SEQ ID NO: 1409836 - DNA, 22 bp, Artificial Sequence
  chemically synthesized
ctcacctaaggtgattcacctg

SEQ ID NO: 1409837 - DNA, 22 bp, Artificial Sequence
  chemically synthesized
tgaggccgaggcaggtgaatca

SEQ ID NO: 1409838 - DNA, 22 bp, Artificial Sequence
  chemically synthesized
aaactcctcacctaaggtgatt

SEQ ID NO: 1409839 - DNA, 22 bp, Artificial Sequence
  chemically synthesized
gtctcaaactcctcacctaagg

SEQ ID NO: 1409840 - DNA, 22 bp, Artificial Sequence
  chemically synthesized
gtcaggctggtctcaaactcct

SEQ ID NO: 1409841 - DNA, 22 bp, Artificial Sequence
  chemically synthesized
aggtgaggagtttgagaccagc

SEQ ID NO: 1409842 - DNA, 22 bp, Artificial Sequence
  chemically synthesized
ggtgaggagtttgagaccagcc

SEQ ID NO: 1409843 - DNA, 22 bp, Artificial Sequence
  chemically synthesized
accatgttagtcaggctggtct

SEQ ID NO: 1409844 - DNA, 22 bp, Artificial Sequence
  chemically synthesized
caccatgttagtcaggctggtc

SEQ ID NO: 1409845 - DNA, 22 bp, Artificial Sequence
  chemically synthesized
gagaccagcctgactaacatgg

SEQ ID NO: 1409846 - DNA, 22 bp, Artificial Sequence
  chemically synthesized
agaccagcctgactaacatggt

SEQ ID NO: 1409847 - DNA, 22 bp, Artificial Sequence
  chemically synthesized
gtagagacggggtttcaccatg

SEQ ID NO: 1409848 - DNA, 22 bp, Artificial Sequence
  chemically synthesized
agtagagacggggtttcaccat

SEQ ID NO: 1409849 - DNA, 22 bp, Artificial Sequence
  chemically synthesized
tagtagagacggggtttcacca

SEQ ID NO: 1409850 - DNA, 22 bp, Artificial Sequence
  chemically synthesized
ttagtagagacggggtttcacc

SEQ ID NO: 1409851 - DNA, 22 bp, Artificial Sequence
  chemically synthesized
actaacatggtgaaaccccgtc

SEQ ID NO: 1409852 - DNA, 22 bp, Artificial Sequence
  chemically synthesized
tatttttagtagagacggggtt

SEQ ID NO: 1409853 - DNA, 22 bp, Artificial Sequence
  chemically synthesized
tgtatttttagtagagacgggg

SEQ ID NO: 1409854 - DNA, 22 bp, Artificial Sequence
  chemically synthesized
acatggtgaaaccccgtctcta

SEQ ID NO: 1409855 - DNA, 22 bp, Artificial Sequence
  chemically synthesized
ctgtatttttagtagagacggg

SEQ ID NO: 1409856 - DNA, 22 bp, Artificial Sequence
  chemically synthesized
atttctgtatttttagtagaga

SEQ ID NO: 1409857 - DNA, 22 bp, Artificial Sequence
  chemically synthesized
cgtccggctaatttctgtattt

SEQ ID NO: 1409858 - DNA, 22 bp, Artificial Sequence
  chemically synthesized
tactaaaaatacagaaattagc

SEQ ID NO: 1409859 - DNA, 22 bp, Artificial Sequence
  chemically synthesized
ctaaaaatacagaaattagccg

SEQ ID NO: 1409860 - DNA, 22 bp, Artificial Sequence
  chemically synthesized
aaaatacagaaattagccggac

SEQ ID NO: 1409861 - DNA, 22 bp, Artificial Sequence
  chemically synthesized
caggcgcccgccactacgtccg

SEQ ID NO: 1409862 - DNA, 22 bp, Artificial Sequence
  chemically synthesized
ggattacaggcgcccgccacta

SEQ ID NO: 1409863 - DNA, 22 bp, Artificial Sequence
  chemically synthesized
gccggacgtagtggcgggcgcc

SEQ ID NO: 1409864 - DNA, 22 bp, Artificial Sequence
  chemically synthesized
ccgagtagctgggattacaggc

SEQ ID NO: 1409865 - DNA, 22 bp, Artificial Sequence
  chemically synthesized
agcctcccgagtagctgggatt

SEQ ID NO: 1409866 - DNA, 22 bp, Artificial Sequence
  chemically synthesized
cctcagcctcccgagtagctgg

SEQ ID NO: 1409867 - DNA, 22 bp, Artificial Sequence
  chemically synthesized
ctgcctcagcctcccgagtagc

SEQ ID NO: 1409868 - DNA, 22 bp, Artificial Sequence
  chemically synthesized
tcctgcctcagcctcccgagta

SEQ ID NO: 1409869 - DNA, 22 bp, Artificial Sequence
  chemically synthesized
taatcccagctactcgggaggc

SEQ ID NO: 1409870 - DNA, 22 bp, Artificial Sequence
  chemically synthesized
aagcgattctcctgcctcagcc

SEQ ID NO: 1409871 - DNA, 22 bp, Artificial Sequence
  chemically synthesized
ctcgggaggctgaggcaggaga

SEQ ID NO: 1409872 - DNA, 22 bp, Artificial Sequence
  chemically synthesized
cgggttcaagcgattctcctgc

SEQ ID NO: 1409873 - DNA, 22 bp, Artificial Sequence
  chemically synthesized
gggaggctgaggcaggagaatc

SEQ ID NO: 1409874 - DNA, 22 bp, Artificial Sequence
  chemically synthesized
ccgggttcaagcgattctcctg

SEQ ID NO: 1409875 - DNA, 22 bp, Artificial Sequence
  chemically synthesized
catcttccgggttcaagcgatt

SEQ ID NO: 1409876 - DNA, 22 bp, Artificial Sequence
  chemically synthesized
aggcaggagaatcgcttgaacc

SEQ ID NO: 1409877 - DNA, 22 bp, Artificial Sequence
  chemically synthesized
caacctccatcttccgggttca

SEQ ID NO: 1409878 - DNA, 22 bp, Artificial Sequence
  chemically synthesized
actgcaacctccatcttccggg

SEQ ID NO: 1409879 - DNA, 22 bp, Artificial Sequence
  chemically synthesized
ctcactgcaacctccatcttcc

SEQ ID NO: 1409880 - DNA, 22 bp, Artificial Sequence
  chemically synthesized
tgctcactgcaacctccatctt

SEQ ID NO: 1409881 - DNA, 22 bp, Artificial Sequence
  chemically synthesized
gaacccggaagatggaggttgc

SEQ ID NO: 1409882 - DNA, 22 bp, Artificial Sequence
  chemically synthesized
aacccggaagatggaggttgca

SEQ ID NO: 1409883 - DNA, 22 bp, Artificial Sequence
  chemically synthesized
gagtgcaatgacgggatctctg

SEQ ID NO: 1409884 - DNA, 22 bp, Artificial Sequence
  chemically synthesized
cagtgagcagagatcccgtcat

SEQ ID NO: 1409885 - DNA, 22 bp, Artificial Sequence
  chemically synthesized
tcgcccaggctggagtgcaatg

SEQ ID NO: 1409886 - DNA, 22 bp, Artificial Sequence
  chemically synthesized
tgtcgcccaggctggagtgcaa

SEQ ID NO: 1409887 - DNA, 22 bp, Artificial Sequence
  chemically synthesized
gctctgtcgcccaggctggagt

SEQ ID NO: 1409888 - DNA, 22 bp, Artificial Sequence
  chemically synthesized
cactccagcctgggcgacagag

SEQ ID NO: 1409889 - DNA, 22 bp, Artificial Sequence
  chemically synthesized
agacggagtctggctctgtcgc

SEQ ID NO: 1409890 - DNA, 22 bp, Artificial Sequence
  chemically synthesized
gagacggagtctggctctgtcg

SEQ ID NO: 1409891 - DNA, 22 bp, Artificial Sequence
  chemically synthesized
tgagacggagtctggctctgtc

SEQ ID NO: 1409892 - DNA, 22 bp, Artificial Sequence
  chemically synthesized
ttgagacggagtctggctctgt

SEQ ID NO: 1409893 - DNA, 22 bp, Artificial Sequence
  chemically synthesized
cagcctgggcgacagagccaga

SEQ ID NO: 1409894 - DNA, 22 bp, Artificial Sequence
  chemically synthesized
tttgagacggagtctggctctg

SEQ ID NO: 1409895 - DNA, 22 bp, Artificial Sequence
  chemically synthesized
ttttgagacggagtctggctct

SEQ ID NO: 1409896 - DNA, 22 bp, Artificial Sequence
  chemically synthesized
tttttgagacggagtctggctc

SEQ ID NO: 1409897 - DNA, 22 bp, Artificial Sequence
  chemically synthesized
ttttttgagacggagtctggct

SEQ ID NO: 1409898 - DNA, 22 bp, Artificial Sequence
  chemically synthesized
tttttttgagacggagtctggc

SEQ ID NO: 1409899 - DNA, 22 bp, Artificial Sequence
  chemically synthesized
ttttttttgagacggagtctgg

SEQ ID NO: 1409900 - DNA, 22 bp, Artificial Sequence
  chemically synthesized
tttttttttgagacggagtctg

SEQ ID NO: 1409901 - DNA, 22 bp, Artificial Sequence
  chemically synthesized
ggcgacagagccagactccgtc

SEQ ID NO: 1409902 - DNA, 22 bp, Artificial Sequence
  chemically synthesized
ttttttttttgagacggagtct

SEQ ID NO: 1409903 - DNA, 22 bp, Artificial Sequence
  chemically synthesized
tttttttttttgagacggagtc

SEQ ID NO: 1409904 - DNA, 22 bp, Artificial Sequence
  chemically synthesized
ttttttttttttgagacggagt

SEQ ID NO: 1409905 - DNA, 22 bp, Artificial Sequence
  chemically synthesized
tttttttttttttgagacggag

SEQ ID NO: 1409906 - DNA, 22 bp, Artificial Sequence
  chemically synthesized
ttttttttttttttgagacgga

SEQ ID NO: 1409907 - DNA, 22 bp, Artificial Sequence
  chemically synthesized
tttttttttttttttgagacgg

SEQ ID NO: 1409908 - DNA, 22 bp, Artificial Sequence
  chemically synthesized
ttttttttttttttttgagacg

SEQ ID NO: 1409909 - DNA, 22 bp, Artificial Sequence
  chemically synthesized
tttttttttttttttttgagac

SEQ ID NO: 1409910 - DNA, 22 bp, Artificial Sequence
  chemically synthesized
ttttttttttttttttttgaga

SEQ ID NO: 1409911 - DNA, 22 bp, Artificial Sequence
  chemically synthesized
tttttttttttttttttttgag

SEQ ID NO: 1409912 - DNA, 22 bp, Artificial Sequence
  chemically synthesized
aagatttttttttttttttttt

SEQ ID NO: 1409913 - DNA, 22 bp, Artificial Sequence
  chemically synthesized
cgtctcaaaaaaaaaaaaaaaa

SEQ ID NO: 1409914 - DNA, 22 bp, Artificial Sequence
  chemically synthesized
attaaagatttttttttttttt

SEQ ID NO: 1409915 - DNA, 22 bp, Artificial Sequence
  chemically synthesized
aaaaaaaaaaaaaaaaaaaaaa

SEQ ID NO: 1409916 - DNA, 22 bp, Artificial Sequence
  chemically synthesized
caaagcattgattaaagatttt

SEQ ID NO: 1409917 - DNA, 22 bp, Artificial Sequence
  chemically synthesized
tacagtgaaaactacaaagcat

SEQ ID NO: 1409918 - DNA, 22 bp, Artificial Sequence
  chemically synthesized
atacagtgaaaactacaaagca

SEQ ID NO: 1409919 - DNA, 22 bp, Artificial Sequence
  chemically synthesized
taatcaatgctttgtagttttc

SEQ ID NO: 1409920 - DNA, 22 bp, Artificial Sequence
  chemically synthesized
aatcaatgctttgtagttttca

SEQ ID NO: 1409921 - DNA, 22 bp, Artificial Sequence
  chemically synthesized
atcaatgctttgtagttttcac

SEQ ID NO: 1409922 - DNA, 22 bp, Artificial Sequence
  chemically synthesized
aaatggtgaaatatttatacag

SEQ ID NO: 1409923 - DNA, 22 bp, Artificial Sequence
  chemically synthesized
tgtagttttcactgtataaata

SEQ ID NO: 1409924 - DNA, 22 bp, Artificial Sequence
  chemically synthesized
gtagttttcactgtataaatat

SEQ ID NO: 1409925 - DNA, 22 bp, Artificial Sequence
  chemically synthesized
tagttttcactgtataaatatt

SEQ ID NO: 1409926 - DNA, 22 bp, Artificial Sequence
  chemically synthesized
actaaaatggtgaaatatttat

SEQ ID NO: 1409927 - DNA, 22 bp, Artificial Sequence
  chemically synthesized
aactaaaatggtgaaatattta

SEQ ID NO: 1409928 - DNA, 22 bp, Artificial Sequence
  chemically synthesized
tcactgtataaatatttcacca

SEQ ID NO: 1409929 - DNA, 22 bp, Artificial Sequence
  chemically synthesized
cactgtataaatatttcaccat

SEQ ID NO: 1409930 - DNA, 22 bp, Artificial Sequence
  chemically synthesized
actgtataaatatttcaccatt

SEQ ID NO: 1409931 - DNA, 22 bp, Artificial Sequence
  chemically synthesized
tataaatatttcaccattttag

SEQ ID NO: 1409932 - DNA, 22 bp, Artificial Sequence
  chemically synthesized
caccattttagttaaatttatt

SEQ ID NO: 1409933 - DNA, 22 bp, Artificial Sequence
  chemically synthesized
accattttagttaaatttattc

SEQ ID NO: 1409934 - DNA, 22 bp, Artificial Sequence
  chemically synthesized
tagttaaatttattcctctttt

SEQ ID NO: 1409935 - DNA, 22 bp, Artificial Sequence
  chemically synthesized
agttaaatttattcctctttta

SEQ ID NO: 1409936 - DNA, 22 bp, Artificial Sequence
  chemically synthesized
gttaaatttattcctcttttat

SEQ ID NO: 1409937 - DNA, 22 bp, Artificial Sequence
  chemically synthesized
aatttattcctcttttattctt

SEQ ID NO: 1409938 - DNA, 22 bp, Artificial Sequence
  chemically synthesized
cagtatcatcaggaagaataaa

SEQ ID NO: 1409939 - DNA, 22 bp, Artificial Sequence
  chemically synthesized
acagtatcatcaggaagaataa

SEQ ID NO: 1409940 - DNA, 22 bp, Artificial Sequence
  chemically synthesized
attcctcttttattcttcctga

SEQ ID NO: 1409941 - DNA, 22 bp, Artificial Sequence
  chemically synthesized
ttcctcttttattcttcctgat

SEQ ID NO: 1409942 - DNA, 22 bp, Artificial Sequence
  chemically synthesized
atttacagtatcatcaggaaga

SEQ ID NO: 1409943 - DNA, 22 bp, Artificial Sequence
  chemically synthesized
catttacagtatcatcaggaag

SEQ ID NO: 1409944 - DNA, 22 bp, Artificial Sequence
  chemically synthesized
ctcttttattcttcctgatgat

SEQ ID NO: 1409945 - DNA, 22 bp, Artificial Sequence
  chemically synthesized
ttttattcttcctgatgatact

SEQ ID NO: 1409946 - DNA, 22 bp, Artificial Sequence
  chemically synthesized
ttattcttcctgatgatactgt

SEQ ID NO: 1409947 - DNA, 22 bp, Artificial Sequence
  chemically synthesized
tattcttcctgatgatactgta

SEQ ID NO: 1409948 - DNA, 22 bp, Artificial Sequence
  chemically synthesized
attcttcctgatgatactgtaa

SEQ ID NO: 1409949 - DNA, 22 bp, Artificial Sequence
  chemically synthesized
ttcttcctgatgatactgtaaa

SEQ ID NO: 1409950 - DNA, 22 bp, Artificial Sequence
  chemically synthesized
gaaaacaatttcatttacagta

SEQ ID NO: 1409951 - DNA, 22 bp, Artificial Sequence
  chemically synthesized
agaaaacaatttcatttacagt

SEQ ID NO: 1409952 - DNA, 22 bp, Artificial Sequence
  chemically synthesized
ttcctgatgatactgtaaatga

SEQ ID NO: 1409953 - DNA, 22 bp, Artificial Sequence
  chemically synthesized
cctgatgatactgtaaatgaaa

SEQ ID NO: 1409954 - DNA, 22 bp, Artificial Sequence
  chemically synthesized
ctgatgatactgtaaatgaaat

SEQ ID NO: 1409955 - DNA, 22 bp, Artificial Sequence
  chemically synthesized
atgatactgtaaatgaaattgt

SEQ ID NO: 1409956 - DNA, 22 bp, Artificial Sequence
  chemically synthesized
atggcacttagaaaacaatttc

SEQ ID NO: 1409957 - DNA, 22 bp, Artificial Sequence
  chemically synthesized
ttaatggcacttagaaaacaat

SEQ ID NO: 1409958 - DNA, 22 bp, Artificial Sequence
  chemically synthesized
taaatgaaattgttttctaagt

SEQ ID NO: 1409959 - DNA, 22 bp, Artificial Sequence
  chemically synthesized
tctgttaatggcacttagaaaa

SEQ ID NO: 1409960 - DNA, 22 bp, Artificial Sequence
  chemically synthesized
atctgttaatggcacttagaaa

SEQ ID NO: 1409961 - DNA, 22 bp, Artificial Sequence
  chemically synthesized
tccatttatctgttaatggcac

SEQ ID NO: 1409962 - DNA, 22 bp, Artificial Sequence
  chemically synthesized
atccatttatctgttaatggca

SEQ ID NO: 1409963 - DNA, 22 bp, Artificial Sequence
  chemically synthesized
tatccatttatctgttaatggc

SEQ ID NO: 1409964 - DNA, 22 bp, Artificial Sequence
  chemically synthesized
ttatccatttatctgttaatgg

SEQ ID NO: 1409965 - DNA, 22 bp, Artificial Sequence
  chemically synthesized
ttttctaagtgccattaacaga

SEQ ID NO: 1409966 - DNA, 22 bp, Artificial Sequence
  chemically synthesized
tttatccatttatctgttaatg

SEQ ID NO: 1409967 - DNA, 22 bp, Artificial Sequence
  chemically synthesized
ttttatccatttatctgttaat

SEQ ID NO: 1409968 - DNA, 22 bp, Artificial Sequence
  chemically synthesized
tctaagtgccattaacagataa

SEQ ID NO: 1409969 - DNA, 22 bp, Artificial Sequence
  chemically synthesized
ctaagtgccattaacagataaa

SEQ ID NO: 1409970 - DNA, 22 bp, Artificial Sequence
  chemically synthesized
taagtgccattaacagataaat

SEQ ID NO: 1409971 - DNA, 22 bp, Artificial Sequence
  chemically synthesized
agtgccattaacagataaatgg

SEQ ID NO: 1409972 - DNA, 22 bp, Artificial Sequence
  chemically synthesized
acagataaatggataaaaaagt

SEQ ID NO: 1409973 - DNA, 22 bp, Artificial Sequence
  chemically synthesized
tgtgtgtgtgtatatatatata

SEQ ID NO: 1409974 - DNA, 22 bp, Artificial Sequence
  chemically synthesized
cgttgtgtgtgtgtgtatatat

SEQ ID NO: 1409975 - DNA, 22 bp, Artificial Sequence
  chemically synthesized
tgtgttccgttgtgtgtgtgtg

SEQ ID NO: 1409976 - DNA, 22 bp, Artificial Sequence
  chemically synthesized
cgttgtgtgttccgttgtgtgt

SEQ ID NO: 1409977 - DNA, 22 bp, Artificial Sequence
  chemically synthesized
tataaatgaatattccgttgtg

SEQ ID NO: 1409978 - DNA, 22 bp, Artificial Sequence
  chemically synthesized
atataaatgaatattccgttgt

SEQ ID NO: 1409979 - DNA, 22 bp, Artificial Sequence
  chemically synthesized
tatataaatgaatattccgttg

SEQ ID NO: 1409980 - DNA, 22 bp, Artificial Sequence
  chemically synthesized
ttatataaatgaatattccgtt

SEQ ID NO: 1409981 - DNA, 22 bp, Artificial Sequence
  chemically synthesized
tttatataaatgaatattccgt

SEQ ID NO: 1409982 - DNA, 22 bp, Artificial Sequence
  chemically synthesized
ttttatataaatgaatattccg

SEQ ID NO: 1409983 - DNA, 22 bp, Artificial Sequence
  chemically synthesized
tttttatataaatgaatattcc

SEQ ID NO: 1409984 - DNA, 22 bp, Artificial Sequence
  chemically synthesized
caaatggtaagttttttttata

SEQ ID NO: 1409985 - DNA, 22 bp, Artificial Sequence
  chemically synthesized
ttgcaaatggtaagtttttttt

SEQ ID NO: 1409986 - DNA, 22 bp, Artificial Sequence
  chemically synthesized
atttatataaaaaaaacttacc

SEQ ID NO: 1409987 - DNA, 22 bp, Artificial Sequence
  chemically synthesized
atataaaaaaaacttaccattt

SEQ ID NO: 1409988 - DNA, 22 bp, Artificial Sequence
  chemically synthesized
tataaaaaaaacttaccatttg

SEQ ID NO: 1409989 - DNA, 22 bp, Artificial Sequence
  chemically synthesized
tccatgttgttgcaaatggtaa

SEQ ID NO: 1409990 - DNA, 22 bp, Artificial Sequence
  chemically synthesized
tatccatgttgttgcaaatggt

SEQ ID NO: 1409991 - DNA, 22 bp, Artificial Sequence
  chemically synthesized
agttctatccatgttgttgcaa

SEQ ID NO: 1409992 - DNA, 22 bp, Artificial Sequence
  chemically synthesized
cagttctatccatgttgttgca

SEQ ID NO: 1409993 - DNA, 22 bp, Artificial Sequence
  chemically synthesized
accatttgcaacaacatggata

SEQ ID NO: 1409994 - DNA, 22 bp, Artificial Sequence
  chemically synthesized
ccatttgcaacaacatggatag

SEQ ID NO: 1409995 - DNA, 22 bp, Artificial Sequence
  chemically synthesized
gcaacaacatggatagaactga

SEQ ID NO: 1409996 - DNA, 22 bp, Artificial Sequence
  chemically synthesized
acaaaatgtccttcagttctat

SEQ ID NO: 1409997 - DNA, 22 bp, Artificial Sequence
  chemically synthesized
caacaacatggatagaactgaa

SEQ ID NO: 1409998 - DNA, 22 bp, Artificial Sequence
  chemically synthesized
aacaaaatgtccttcagttcta

SEQ ID NO: 1409999 - DNA, 22 bp, Artificial Sequence
  chemically synthesized
acttaacaaaatgtccttcagt

SEQ ID NO: 1410000 - DNA, 22 bp, Artificial Sequence
  chemically synthesized
cacttaacaaaatgtccttcag

SEQ ID NO: 1410001 - DNA, 22 bp, Artificial Sequence
  chemically synthesized
tttcacttaacaaaatgtcctt

SEQ ID NO: 1410002 - DNA, 22 bp, Artificial Sequence
  chemically synthesized
atttcacttaacaaaatgtcct

SEQ ID NO: 1410003 - DNA, 22 bp, Artificial Sequence
  chemically synthesized
gcttatttcacttaacaaaatg

SEQ ID NO: 1410004 - DNA, 22 bp, Artificial Sequence
  chemically synthesized
tgcctggcttatttcacttaac

SEQ ID NO: 1410005 - DNA, 22 bp, Artificial Sequence
  chemically synthesized
aaggacattttgttaagtgaaa

SEQ ID NO: 1410006 - DNA, 22 bp, Artificial Sequence
  chemically synthesized
tgtgcctggcttatttcactta

SEQ ID NO: 1410007 - DNA, 22 bp, Artificial Sequence
  chemically synthesized
ctgtgcctggcttatttcactt

SEQ ID NO: 1410008 - DNA, 22 bp, Artificial Sequence
  chemically synthesized
tctgtgcctggcttatttcact

SEQ ID NO: 1410009 - DNA, 22 bp, Artificial Sequence
  chemically synthesized
tctttctgtgcctggcttattt

SEQ ID NO: 1410010 - DNA, 22 bp, Artificial Sequence
  chemically synthesized
gtctttctgtgcctggcttatt

SEQ ID NO: 1410011 - DNA, 22 bp, Artificial Sequence
  chemically synthesized
tgttaagtgaaataagccaggc

SEQ ID NO: 1410012 - DNA, 22 bp, Artificial Sequence
  chemically synthesized
gttaagtgaaataagccaggca

SEQ ID NO: 1410013 - DNA, 22 bp, Artificial Sequence
  chemically synthesized
ttaagtgaaataagccaggcac

SEQ ID NO: 1410014 - DNA, 22 bp, Artificial Sequence
  chemically synthesized
agtgaaataagccaggcacaga

SEQ ID NO: 1410015 - DNA, 22 bp, Artificial Sequence
  chemically synthesized
ccacatatgagtgagaacgtgt

SEQ ID NO: 1410016 - DNA, 22 bp, Artificial Sequence
  chemically synthesized
gctcccacatatgagtgagaac

SEQ ID NO: 1410017 - DNA, 22 bp, Artificial Sequence
  chemically synthesized
agctcccacatatgagtgagaa

SEQ ID NO: 1410018 - DNA, 22 bp, Artificial Sequence
  chemically synthesized
tagctcccacatatgagtgaga

SEQ ID NO: 1410019 - DNA, 22 bp, Artificial Sequence
  chemically synthesized
ttttagctcccacatatgagtg

SEQ ID NO: 1410020 - DNA, 22 bp, Artificial Sequence
  chemically synthesized
cacgttctcactcatatgtggg

SEQ ID NO: 1410021 - DNA, 22 bp, Artificial Sequence
  chemically synthesized
tcactcatatgtgggagctaaa

SEQ ID NO: 1410022 - DNA, 22 bp, Artificial Sequence
  chemically synthesized
actcatatgtgggagctaaaat

SEQ ID NO: 1410023 - DNA, 22 bp, Artificial Sequence
  chemically synthesized
catgagatcaattattttagct

SEQ ID NO: 1410024 - DNA, 22 bp, Artificial Sequence
  chemically synthesized
atatgtgggagctaaaataatt

SEQ ID NO: 1410025 - DNA, 22 bp, Artificial Sequence
  chemically synthesized
cctccatgagatcaattatttt

SEQ ID NO: 1410026 - DNA, 22 bp, Artificial Sequence
  chemically synthesized
actacctccatgagatcaatta

SEQ ID NO: 1410027 - DNA, 22 bp, Artificial Sequence
  chemically synthesized
tactcactacctccatgagatc

SEQ ID NO: 1410028 - DNA, 22 bp, Artificial Sequence
  chemically synthesized
ttgtactcactacctccatgag

SEQ ID NO: 1410029 - DNA, 22 bp, Artificial Sequence
  chemically synthesized
aaataattgatctcatggaggt

SEQ ID NO: 1410030 - DNA, 22 bp, Artificial Sequence
  chemically synthesized
atctcatggaggtagtgagtac

SEQ ID NO: 1410031 - DNA, 22 bp, Artificial Sequence
  chemically synthesized
gtaaccactattgtactcacta

SEQ ID NO: 1410032 - DNA, 22 bp, Artificial Sequence
  chemically synthesized
atggaggtagtgagtacaatag

SEQ ID NO: 1410033 - DNA, 22 bp, Artificial Sequence
  chemically synthesized
agacgctcgtaaccactattgt

SEQ ID NO: 1410034 - DNA, 22 bp, Artificial Sequence
  chemically synthesized
tcagacgctcgtaaccactatt

SEQ ID NO: 1410035 - DNA, 22 bp, Artificial Sequence
  chemically synthesized
ctcagacgctcgtaaccactat

SEQ ID NO: 1410036 - DNA, 22 bp, Artificial Sequence
  chemically synthesized
ccttctcagacgctcgtaacca

SEQ ID NO: 1410037 - DNA, 22 bp, Artificial Sequence
  chemically synthesized
cccttctcagacgctcgtaacc

SEQ ID NO: 1410038 - DNA, 22 bp, Artificial Sequence
  chemically synthesized
acttcccttctcagacgctcgt

SEQ ID NO: 1410039 - DNA, 22 bp, Artificial Sequence
  chemically synthesized
cacttcccttctcagacgctcg

SEQ ID NO: 1410040 - DNA, 22 bp, Artificial Sequence
  chemically synthesized
ttcacttcccttctcagacgct

SEQ ID NO: 1410041 - DNA, 22 bp, Artificial Sequence
  chemically synthesized
tcttcacttcccttctcagacg

SEQ ID NO: 1410042 - DNA, 22 bp, Artificial Sequence
  chemically synthesized
ctcttcacttcccttctcagac

SEQ ID NO: 1410043 - DNA, 22 bp, Artificial Sequence
  chemically synthesized
cgagcgtctgagaagggaagtg

SEQ ID NO: 1410044 - DNA, 22 bp, Artificial Sequence
  chemically synthesized
atccccttctcttcacttccct

SEQ ID NO: 1410045 - DNA, 22 bp, Artificial Sequence
  chemically synthesized
catccccttctcttcacttccc

SEQ ID NO: 1410046 - DNA, 22 bp, Artificial Sequence
  chemically synthesized
ttcatccccttctcttcacttc

SEQ ID NO: 1410047 - DNA, 22 bp, Artificial Sequence
  chemically synthesized
tcttcatccccttctcttcact

SEQ ID NO: 1410048 - DNA, 22 bp, Artificial Sequence
  chemically synthesized
agaagggaagtgaagagaaggg

SEQ ID NO: 1410049 - DNA, 22 bp, Artificial Sequence
  chemically synthesized
tcctctcttcatccccttctct

SEQ ID NO: 1410050 - DNA, 22 bp, Artificial Sequence
  chemically synthesized
actatcctctcttcatcccctt

SEQ ID NO: 1410051 - DNA, 22 bp, Artificial Sequence
  chemically synthesized
tacccattaactatcctctctt

SEQ ID NO: 1410052 - DNA, 22 bp, Artificial Sequence
  chemically synthesized
tattgtacccattaactatcct

SEQ ID NO: 1410053 - DNA, 22 bp, Artificial Sequence
  chemically synthesized
gtattgtacccattaactatcc

SEQ ID NO: 1410054 - DNA, 22 bp, Artificial Sequence
  chemically synthesized
tgtattgtacccattaactatc

SEQ ID NO: 1410055 - DNA, 22 bp, Artificial Sequence
  chemically synthesized
ttgtattgtacccattaactat

SEQ ID NO: 1410056 - DNA, 22 bp, Artificial Sequence
  chemically synthesized
tacttttgtattgtacccatta

SEQ ID NO: 1410057 - DNA, 22 bp, Artificial Sequence
  chemically synthesized
actgtacttttgtattgtaccc

SEQ ID NO: 1410058 - DNA, 22 bp, Artificial Sequence
  chemically synthesized
tctaactgtacttttgtattgt

SEQ ID NO: 1410059 - DNA, 22 bp, Artificial Sequence
  chemically synthesized
atctaactgtacttttgtattg

SEQ ID NO: 1410060 - DNA, 22 bp, Artificial Sequence
  chemically synthesized
tatctaactgtacttttgtatt

SEQ ID NO: 1410061 - DNA, 22 bp, Artificial Sequence
  chemically synthesized
ttatctaactgtacttttgtat

SEQ ID NO: 1410062 - DNA, 22 bp, Artificial Sequence
  chemically synthesized
ttttatctaactgtacttttgt

SEQ ID NO: 1410063 - DNA, 22 bp, Artificial Sequence
  chemically synthesized
atgggtacaatacaaaagtaca

SEQ ID NO: 1410064 - DNA, 22 bp, Artificial Sequence
  chemically synthesized
cttttatctaactgtacttttg

SEQ ID NO: 1410065 - DNA, 22 bp, Artificial Sequence
  chemically synthesized
tttcttttatctaactgtactt

SEQ ID NO: 1410066 - DNA, 22 bp, Artificial Sequence
  chemically synthesized
atttcttttatctaactgtact

SEQ ID NO: 1410067 - DNA, 22 bp, Artificial Sequence
  chemically synthesized
gaatttatttcttttatctaac

SEQ ID NO: 1410068 - DNA, 22 bp, Artificial Sequence
  chemically synthesized
aaacactagaatttatttcttt

SEQ ID NO: 1410069 - DNA, 22 bp, Artificial Sequence
  chemically synthesized
tcaaacactagaatttatttct

SEQ ID NO: 1410070 - DNA, 22 bp, Artificial Sequence
  chemically synthesized
tgctctcaaacactagaattta

SEQ ID NO: 1410071 - DNA, 22 bp, Artificial Sequence
  chemically synthesized
gataaaagaaataaattctagt

SEQ ID NO: 1410072 - DNA, 22 bp, Artificial Sequence
  chemically synthesized
ctatgctctcaaacactagaat

SEQ ID NO: 1410073 - DNA, 22 bp, Artificial Sequence
  chemically synthesized
ccctactatgctctcaaacact

SEQ ID NO: 1410074 - DNA, 22 bp, Artificial Sequence
  chemically synthesized
tagctgccctactatgctctca

SEQ ID NO: 1410075 - DNA, 22 bp, Artificial Sequence
  chemically synthesized
actatagctgccctactatgct

SEQ ID NO: 1410076 - DNA, 22 bp, Artificial Sequence
  chemically synthesized
tagtgtttgagagcatagtagg

SEQ ID NO: 1410077 - DNA, 22 bp, Artificial Sequence
  chemically synthesized
gtgtttgagagcatagtagggc

SEQ ID NO: 1410078 - DNA, 22 bp, Artificial Sequence
  chemically synthesized
atgttaactatagctgccctac

SEQ ID NO: 1410079 - DNA, 22 bp, Artificial Sequence
  chemically synthesized
gagagcatagtagggcagctat

SEQ ID NO: 1410080 - DNA, 22 bp, Artificial Sequence
  chemically synthesized
agagcatagtagggcagctata

SEQ ID NO: 1410081 - DNA, 22 bp, Artificial Sequence
  chemically synthesized
taaattcatgttaactatagct

SEQ ID NO: 1410082 - DNA, 22 bp, Artificial Sequence
  chemically synthesized
aaatatactataaattcatgtt

SEQ ID NO: 1410083 - DNA, 22 bp, Artificial Sequence
  chemically synthesized
gaaatatactataaattcatgt

SEQ ID NO: 1410084 - DNA, 22 bp, Artificial Sequence
  chemically synthesized
tagttaacatgaatttatagta

SEQ ID NO: 1410085 - DNA, 22 bp, Artificial Sequence
  chemically synthesized
gcaatttgaaatatactataaa

SEQ ID NO: 1410086 - DNA, 22 bp, Artificial Sequence
  chemically synthesized
tggcaatttgaaatatactata

SEQ ID NO: 1410087 - DNA, 22 bp, Artificial Sequence
  chemically synthesized
ctggcaatttgaaatatactat

SEQ ID NO: 1410088 - DNA, 22 bp, Artificial Sequence
  chemically synthesized
acatgaatttatagtatatttc

SEQ ID NO: 1410089 - DNA, 22 bp, Artificial Sequence
  chemically synthesized
ttctggcaatttgaaatatact

SEQ ID NO: 1410090 - DNA, 22 bp, Artificial Sequence
  chemically synthesized
tcttctggcaatttgaaatata

SEQ ID NO: 1410091 - DNA, 22 bp, Artificial Sequence
  chemically synthesized
ctcttctggcaatttgaaatat

SEQ ID NO: 1410092 - DNA, 22 bp, Artificial Sequence
  chemically synthesized
atagtatatttcaaattgccag

SEQ ID NO: 1410093 - DNA, 22 bp, Artificial Sequence
  chemically synthesized
tagtatatttcaaattgccaga

SEQ ID NO: 1410094 - DNA, 22 bp, Artificial Sequence
  chemically synthesized
caaatcttctcttctggcaatt

SEQ ID NO: 1410095 - DNA, 22 bp, Artificial Sequence
  chemically synthesized
caaattgccagaagagaagatt

SEQ ID NO: 1410096 - DNA, 22 bp, Artificial Sequence
  chemically synthesized
aaattgccagaagagaagattt

SEQ ID NO: 1410097 - DNA, 22 bp, Artificial Sequence
  chemically synthesized
taatgggaacattccaaatctt

SEQ ID NO: 1410098 - DNA, 22 bp, Artificial Sequence
  chemically synthesized
gtaatgggaacattccaaatct

SEQ ID NO: 1410099 - DNA, 22 bp, Artificial Sequence
  chemically synthesized
tgtaatgggaacattccaaatc

SEQ ID NO: 1410100 - DNA, 22 bp, Artificial Sequence
  chemically synthesized
ccagaagagaagatttggaatg

SEQ ID NO: 1410101 - DNA, 22 bp, Artificial Sequence
  chemically synthesized
tttgtaatgggaacattccaaa

SEQ ID NO: 1410102 - DNA, 22 bp, Artificial Sequence
  chemically synthesized
ctttgtaatgggaacattccaa

SEQ ID NO: 1410103 - DNA, 22 bp, Artificial Sequence
  chemically synthesized
tcatttctttgtaatgggaaca

SEQ ID NO: 1410104 - DNA, 22 bp, Artificial Sequence
  chemically synthesized
atcatttctttgtaatgggaac

SEQ ID NO: 1410105 - DNA, 22 bp, Artificial Sequence
  chemically synthesized
ggaatgttcccattacaaagaa

SEQ ID NO: 1410106 - DNA, 22 bp, Artificial Sequence
  chemically synthesized
gaatgttcccattacaaagaaa

SEQ ID NO: 1410107 - DNA, 22 bp, Artificial Sequence
  chemically synthesized
aaatatttatcatttctttgta

SEQ ID NO: 1410108 - DNA, 22 bp, Artificial Sequence
  chemically synthesized
ccattacaaagaaatgataaat

SEQ ID NO: 1410109 - DNA, 22 bp, Artificial Sequence
  chemically synthesized
caaagaaatgataaatatttga

SEQ ID NO: 1410110 - DNA, 22 bp, Artificial Sequence
  chemically synthesized
ggatgtccatcatctcaaatat

SEQ ID NO: 1410111 - DNA, 22 bp, Artificial Sequence
  chemically synthesized
gagatgatggacatcctaatca

SEQ ID NO: 1410112 - DNA, 22 bp, Artificial Sequence
  chemically synthesized
agatgatggacatcctaatcac

SEQ ID NO: 1410113 - DNA, 22 bp, Artificial Sequence
  chemically synthesized
atcaccttgattcgatcattac

SEQ ID NO: 1410114 - DNA, 22 bp, Artificial Sequence
  chemically synthesized
caatatatacatacaatgtgta

SEQ ID NO: 1410115 - DNA, 22 bp, Artificial Sequence
  chemically synthesized
gattcgatcattacacattgta

SEQ ID NO: 1410116 - DNA, 22 bp, Artificial Sequence
  chemically synthesized
attcgatcattacacattgtat

SEQ ID NO: 1410117 - DNA, 22 bp, Artificial Sequence
  chemically synthesized
gatcattacacattgtatgtat

SEQ ID NO: 1410118 - DNA, 22 bp, Artificial Sequence
  chemically synthesized
cacattgtatgtatatattgga

SEQ ID NO: 1410119 - DNA, 22 bp, Artificial Sequence
  chemically synthesized
tggggtacatgtgatattccaa

SEQ ID NO: 1410120 - DNA, 22 bp, Artificial Sequence
  chemically synthesized
atggggtacatgtgatattcca

SEQ ID NO: 1410121 - DNA, 22 bp, Artificial Sequence
  chemically synthesized
tatgtatatattggaatatcac

SEQ ID NO: 1410122 - DNA, 22 bp, Artificial Sequence
  chemically synthesized
cacatttatggggtacatgtga

SEQ ID NO: 1410123 - DNA, 22 bp, Artificial Sequence
  chemically synthesized
gaatatcacatgtaccccataa

SEQ ID NO: 1410124 - DNA, 22 bp, Artificial Sequence
  chemically synthesized
atacattacacatttatggggt

SEQ ID NO: 1410125 - DNA, 22 bp, Artificial Sequence
  chemically synthesized
ttgatacattacacatttatgg

SEQ ID NO: 1410126 - DNA, 22 bp, Artificial Sequence
  chemically synthesized
attgatacattacacatttatg

SEQ ID NO: 1410127 - DNA, 22 bp, Artificial Sequence
  chemically synthesized
tattgatacattacacatttat

SEQ ID NO: 1410128 - DNA, 22 bp, Artificial Sequence
  chemically synthesized
ttattgatacattacacattta

SEQ ID NO: 1410129 - DNA, 22 bp, Artificial Sequence
  chemically synthesized
tttattgatacattacacattt

SEQ ID NO: 1410130 - DNA, 22 bp, Artificial Sequence
  chemically synthesized
gctttttattgatacattacac

SEQ ID NO: 1410131 - DNA, 22 bp, Artificial Sequence
  chemically synthesized
agctttttattgatacattaca

SEQ ID NO: 1410132 - DNA, 22 bp, Artificial Sequence
  chemically synthesized
gatttagctttttattgataca

SEQ ID NO: 1410133 - DNA, 22 bp, Artificial Sequence
  chemically synthesized
agatttagctttttattgatac

SEQ ID NO: 1410134 - DNA, 22 bp, Artificial Sequence
  chemically synthesized
aaaaggaaatcaataaaatgtt

SEQ ID NO: 1410135 - DNA, 22 bp, Artificial Sequence
  chemically synthesized
gaaaaggaaatcaataaaatgt

SEQ ID NO: 1410136 - DNA, 22 bp, Artificial Sequence
  chemically synthesized
tgaaaaggaaatcaataaaatg

SEQ ID NO: 1410137 - DNA, 22 bp, Artificial Sequence
  chemically synthesized
aatctaaacattttattgattt

SEQ ID NO: 1410138 - DNA, 22 bp, Artificial Sequence
  chemically synthesized
attttgaaaaggaaatcaataa

SEQ ID NO: 1410139 - DNA, 22 bp, Artificial Sequence
  chemically synthesized
cattttgaaaaggaaatcaata

SEQ ID NO: 1410140 - DNA, 22 bp, Artificial Sequence
  chemically synthesized
atttcattttgaaaaggaaatc

SEQ ID NO: 1410141 - DNA, 22 bp, Artificial Sequence
  chemically synthesized
aacattttattgatttcctttt

SEQ ID NO: 1410142 - DNA, 22 bp, Artificial Sequence
  chemically synthesized
tattgatttccttttcaaaatg

SEQ ID NO: 1410143 - DNA, 22 bp, Artificial Sequence
  chemically synthesized
attgatttccttttcaaaatga

SEQ ID NO: 1410144 - DNA, 22 bp, Artificial Sequence
  chemically synthesized
ttgatttccttttcaaaatgaa

SEQ ID NO: 1410145 - DNA, 22 bp, Artificial Sequence
  chemically synthesized
atttccttttcaaaatgaaatc

SEQ ID NO: 1410146 - DNA, 22 bp, Artificial Sequence
  chemically synthesized
aaaatgaaatcagttgatttca

SEQ ID NO: 1410147 - DNA, 22 bp, Artificial Sequence
  chemically synthesized
ccttttcaaaatgaaatcaact

SEQ ID NO: 1410148 - DNA, 22 bp, Artificial Sequence
  chemically synthesized
cttttcaaaatgaaatcaactg

SEQ ID NO: 1410149 - DNA, 22 bp, Artificial Sequence
  chemically synthesized
taaaaatgaaatcagttgattt

SEQ ID NO: 1410150 - DNA, 22 bp, Artificial Sequence
  chemically synthesized
tctaaaaatgaaatcagttgat

SEQ ID NO: 1410151 - DNA, 22 bp, Artificial Sequence
  chemically synthesized
ttcaaaatgaaatcaactgatt

SEQ ID NO: 1410152 - DNA, 22 bp, Artificial Sequence
  chemically synthesized
ctctaaaaatgaaatcagttga

SEQ ID NO: 1410153 - DNA, 22 bp, Artificial Sequence
  chemically synthesized
tcaaaatgaaatcaactgattt

SEQ ID NO: 1410154 - DNA, 22 bp, Artificial Sequence
  chemically synthesized
tctctaaaaatgaaatcagttg

SEQ ID NO: 1410155 - DNA, 22 bp, Artificial Sequence
  chemically synthesized
caaaatgaaatcaactgatttc

SEQ ID NO: 1410156 - DNA, 22 bp, Artificial Sequence
  chemically synthesized
ttctctaaaaatgaaatcagtt

SEQ ID NO: 1410157 - DNA, 22 bp, Artificial Sequence
  chemically synthesized
aaaatgaaatcaactgatttca

SEQ ID NO: 1410158 - DNA, 22 bp, Artificial Sequence
  chemically synthesized
ttttctctaaaaatgaaatcag

SEQ ID NO: 1410159 - DNA, 22 bp, Artificial Sequence
  chemically synthesized
cttttctctaaaaatgaaatca

SEQ ID NO: 1410160 - DNA, 22 bp, Artificial Sequence
  chemically synthesized
gtagcatttcttttctctaaaa

SEQ ID NO: 1410161 - DNA, 22 bp, Artificial Sequence
  chemically synthesized
atttcatttttagagaaaagaa

SEQ ID NO: 1410162 - DNA, 22 bp, Artificial Sequence
  chemically synthesized
catttttagagaaaagaaatgc

SEQ ID NO: 1410163 - DNA, 22 bp, Artificial Sequence
  chemically synthesized
atttttagagaaaagaaatgct

SEQ ID NO: 1410164 - DNA, 22 bp, Artificial Sequence
  chemically synthesized
ttagagaaaagaaatgctacca

SEQ ID NO: 1410165 - DNA, 22 bp, Artificial Sequence
  chemically synthesized
tagagaaaagaaatgctaccaa

SEQ ID NO: 1410166 - DNA, 22 bp, Artificial Sequence
  chemically synthesized
agagaaaagaaatgctaccaat

SEQ ID NO: 1410167 - DNA, 22 bp, Artificial Sequence
  chemically synthesized
gagaaaagaaatgctaccaata

SEQ ID NO: 1410168 - DNA, 22 bp, Artificial Sequence
  chemically synthesized
gatacaaaatcaacatacaaat

SEQ ID NO: 1410169 - DNA, 22 bp, Artificial Sequence
  chemically synthesized
ctagatacaaaatcaacataca

SEQ ID NO: 1410170 - DNA, 22 bp, Artificial Sequence
  chemically synthesized
ccaatatttgtatgttgatttt

SEQ ID NO: 1410171 - DNA, 22 bp, Artificial Sequence
  chemically synthesized
agtaaaattgctagatacaaaa

SEQ ID NO: 1410172 - DNA, 22 bp, Artificial Sequence
  chemically synthesized
gtatgttgattttgtatctagc

SEQ ID NO: 1410173 - DNA, 22 bp, Artificial Sequence
  chemically synthesized
tatgttgattttgtatctagca

SEQ ID NO: 1410174 - DNA, 22 bp, Artificial Sequence
  chemically synthesized
attttgtatctagcaattttac

SEQ ID NO: 1410175 - DNA, 22 bp, Artificial Sequence
  chemically synthesized
atcaatgaattcagtaaaattg

SEQ ID NO: 1410176 - DNA, 22 bp, Artificial Sequence
  chemically synthesized
tgtatctagcaattttactgaa

SEQ ID NO: 1410177 - DNA, 22 bp, Artificial Sequence
  chemically synthesized
gtatctagcaattttactgaat

SEQ ID NO: 1410178 - DNA, 22 bp, Artificial Sequence
  chemically synthesized
tatctagcaattttactgaatt

SEQ ID NO: 1410179 - DNA, 22 bp, Artificial Sequence
  chemically synthesized
tcagaactaatcaatgaattca

SEQ ID NO: 1410180 - DNA, 22 bp, Artificial Sequence
  chemically synthesized
gtcagaactaatcaatgaattc

SEQ ID NO: 1410181 - DNA, 22 bp, Artificial Sequence
  chemically synthesized
gcaattttactgaattcattga

SEQ ID NO: 1410182 - DNA, 22 bp, Artificial Sequence
  chemically synthesized
aaaatttgtcagaactaatcaa

SEQ ID NO: 1410183 - DNA, 22 bp, Artificial Sequence
  chemically synthesized
tactgaattcattgattagttc

SEQ ID NO: 1410184 - DNA, 22 bp, Artificial Sequence
  chemically synthesized
actgaattcattgattagttct

SEQ ID NO: 1410185 - DNA, 22 bp, Artificial Sequence
  chemically synthesized
ctgaattcattgattagttctg

SEQ ID NO: 1410186 - DNA, 22 bp, Artificial Sequence
  chemically synthesized
attaaaaatttgtcagaactaa

SEQ ID NO: 1410187 - DNA, 22 bp, Artificial Sequence
  chemically synthesized
cattaaaaatttgtcagaacta

SEQ ID NO: 1410188 - DNA, 22 bp, Artificial Sequence
  chemically synthesized
aattcattgattagttctgaca

SEQ ID NO: 1410189 - DNA, 22 bp, Artificial Sequence
  chemically synthesized
attgattagttctgacaaattt

SEQ ID NO: 1410190 - DNA, 22 bp, Artificial Sequence
  chemically synthesized
atgatttcattaaaaatttgtc

SEQ ID NO: 1410191 - DNA, 22 bp, Artificial Sequence
  chemically synthesized
attagttctgacaaatttttaa

SEQ ID NO: 1410192 - DNA, 22 bp, Artificial Sequence
  chemically synthesized
gttctgacaaatttttaatgaa

SEQ ID NO: 1410193 - DNA, 22 bp, Artificial Sequence
  chemically synthesized
tgacaaatttttaatgaaatca

SEQ ID NO: 1410194 - DNA, 22 bp, Artificial Sequence
  chemically synthesized
acaaatttttaatgaaatcatt

SEQ ID NO: 1410195 - DNA, 22 bp, Artificial Sequence
  chemically synthesized
tatgtagaaagccctaatgatt

SEQ ID NO: 1410196 - DNA, 22 bp, Artificial Sequence
  chemically synthesized
tatatgtagaaagccctaatga

SEQ ID NO: 1410197 - DNA, 22 bp, Artificial Sequence
  chemically synthesized
ttaatgaaatcattagggcttt

SEQ ID NO: 1410198 - DNA, 22 bp, Artificial Sequence
  chemically synthesized
taatgaaatcattagggctttc

SEQ ID NO: 1410199 - DNA, 22 bp, Artificial Sequence
  chemically synthesized
aatgaaatcattagggctttct

SEQ ID NO: 1410200 - DNA, 22 bp, Artificial Sequence
  chemically synthesized
atgaaatcattagggctttcta

SEQ ID NO: 1410201 - DNA, 22 bp, Artificial Sequence
  chemically synthesized
tagatgccacgattctatatgt

SEQ ID NO: 1410202 - DNA, 22 bp, Artificial Sequence
  chemically synthesized
gtagatgccacgattctatatg

SEQ ID NO: 1410203 - DNA, 22 bp, Artificial Sequence
  chemically synthesized
gggctttctacatatagaatcg

SEQ ID NO: 1410204 - DNA, 22 bp, Artificial Sequence
  chemically synthesized
tttgtagatgccacgattctat

SEQ ID NO: 1410205 - DNA, 22 bp, Artificial Sequence
  chemically synthesized
tctgtttgtagatgccacgatt

SEQ ID NO: 1410206 - DNA, 22 bp, Artificial Sequence
  chemically synthesized
tctacatatagaatcgtggcat

SEQ ID NO: 1410207 - DNA, 22 bp, Artificial Sequence
  chemically synthesized
ctacatatagaatcgtggcatc

SEQ ID NO: 1410208 - DNA, 22 bp, Artificial Sequence
  chemically synthesized
tacatatagaatcgtggcatct

SEQ ID NO: 1410209 - DNA, 22 bp, Artificial Sequence
  chemically synthesized
catatagaatcgtggcatctac

SEQ ID NO: 1410210 - DNA, 22 bp, Artificial Sequence
  chemically synthesized
gaaaggaagaagtaaaattatc

SEQ ID NO: 1410211 - DNA, 22 bp, Artificial Sequence
  chemically synthesized
caaacagataattttacttctt

SEQ ID NO: 1410212 - DNA, 22 bp, Artificial Sequence
  chemically synthesized
tacttcttcctttccaattcca

SEQ ID NO: 1410213 - DNA, 22 bp, Artificial Sequence
  chemically synthesized
acttcttcctttccaattccac

SEQ ID NO: 1410214 - DNA, 22 bp, Artificial Sequence
  chemically synthesized
cttcttcctttccaattccact

SEQ ID NO: 1410215 - DNA, 22 bp, Artificial Sequence
  chemically synthesized
cttcctttccaattccactgcc

SEQ ID NO: 1410216 - DNA, 22 bp, Artificial Sequence
  chemically synthesized
ttcctttccaattccactgcct

SEQ ID NO: 1410217 - DNA, 22 bp, Artificial Sequence
  chemically synthesized
cctttccaattccactgccttt

SEQ ID NO: 1410218 - DNA, 22 bp, Artificial Sequence
  chemically synthesized
ctttccaattccactgcctttt

SEQ ID NO: 1410219 - DNA, 22 bp, Artificial Sequence
  chemically synthesized
tccaattccactgccttttatt

SEQ ID NO: 1410220 - DNA, 22 bp, Artificial Sequence
  chemically synthesized
ccaattccactgccttttattt

SEQ ID NO: 1410221 - DNA, 22 bp, Artificial Sequence
  chemically synthesized
ggcaagagaaagaaataaaagg

SEQ ID NO: 1410222 - DNA, 22 bp, Artificial Sequence
  chemically synthesized
caattccactgccttttatttc

SEQ ID NO: 1410223 - DNA, 22 bp, Artificial Sequence
  chemically synthesized
cactgccttttatttctttctc

SEQ ID NO: 1410224 - DNA, 22 bp, Artificial Sequence
  chemically synthesized
ccttttatttctttctcttgcc

SEQ ID NO: 1410225 - DNA, 22 bp, Artificial Sequence
  chemically synthesized
gtcagagcaattaggcaagaga

SEQ ID NO: 1410226 - DNA, 22 bp, Artificial Sequence
  chemically synthesized
ttatttctttctcttgcctaat

SEQ ID NO: 1410227 - DNA, 22 bp, Artificial Sequence
  chemically synthesized
tatttctttctcttgcctaatt

SEQ ID NO: 1410228 - DNA, 22 bp, Artificial Sequence
  chemically synthesized
atttctttctcttgcctaattg

SEQ ID NO: 1410229 - DNA, 22 bp, Artificial Sequence
  chemically synthesized
tttctttctcttgcctaattgc

SEQ ID NO: 1410230 - DNA, 22 bp, Artificial Sequence
  chemically synthesized
ctttctcttgcctaattgctct

SEQ ID NO: 1410231 - DNA, 22 bp, Artificial Sequence
  chemically synthesized
gaagtcctagtcagagcaatta

SEQ ID NO: 1410232 - DNA, 22 bp, Artificial Sequence
  chemically synthesized
tttctcttgcctaattgctctg

SEQ ID NO: 1410233 - DNA, 22 bp, Artificial Sequence
  chemically synthesized
tctcttgcctaattgctctgac

SEQ ID NO: 1410234 - DNA, 22 bp, Artificial Sequence
  chemically synthesized
ctcttgcctaattgctctgact

SEQ ID NO: 1410235 - DNA, 22 bp, Artificial Sequence
  chemically synthesized
tcttgcctaattgctctgacta

SEQ ID NO: 1410236 - DNA, 22 bp, Artificial Sequence
  chemically synthesized
ttgcctaattgctctgactagg

SEQ ID NO: 1410237 - DNA, 22 bp, Artificial Sequence
  chemically synthesized
gcctaattgctctgactaggac

SEQ ID NO: 1410238 - DNA, 22 bp, Artificial Sequence
  chemically synthesized
cctaattgctctgactaggact

SEQ ID NO: 1410239 - DNA, 22 bp, Artificial Sequence
  chemically synthesized
aacatagtattggaagtcctag

SEQ ID NO: 1410240 - DNA, 22 bp, Artificial Sequence
  chemically synthesized
attgctctgactaggacttcca

SEQ ID NO: 1410241 - DNA, 22 bp, Artificial Sequence
  chemically synthesized
ttcaacatagtattggaagtcc

SEQ ID NO: 1410242 - DNA, 22 bp, Artificial Sequence
  chemically synthesized
tgttcaacatagtattggaagt

SEQ ID NO: 1410243 - DNA, 22 bp, Artificial Sequence
  chemically synthesized
ctctgactaggacttccaatac

SEQ ID NO: 1410244 - DNA, 22 bp, Artificial Sequence
  chemically synthesized
ctgttcaacatagtattggaag

SEQ ID NO: 1410245 - DNA, 22 bp, Artificial Sequence
  chemically synthesized
tgactaggacttccaatactat

SEQ ID NO: 1410246 - DNA, 22 bp, Artificial Sequence
  chemically synthesized
actaggacttccaatactatgt

SEQ ID NO: 1410247 - DNA, 22 bp, Artificial Sequence
  chemically synthesized
ggacttccaatactatgttgaa

SEQ ID NO: 1410248 - DNA, 22 bp, Artificial Sequence
  chemically synthesized
ccaatactatgttgaacagaag

SEQ ID NO: 1410249 - DNA, 22 bp, Artificial Sequence
  chemically synthesized
ccatgatcaacacttctgttca

SEQ ID NO: 1410250 - DNA, 22 bp, Artificial Sequence
  chemically synthesized
caatactatgttgaacagaagt

SEQ ID NO: 1410251 - DNA, 22 bp, Artificial Sequence
  chemically synthesized
tgttgaacagaagtgttgatca

SEQ ID NO: 1410252 - DNA, 22 bp, Artificial Sequence
  chemically synthesized
aacagaagtgttgatcatggga

SEQ ID NO: 1410253 - DNA, 22 bp, Artificial Sequence
  chemically synthesized
gtacaatgcagggattcccatg

SEQ ID NO: 1410254 - DNA, 22 bp, Artificial Sequence
  chemically synthesized
agatctggtacaatgcagggat

SEQ ID NO: 1410255 - DNA, 22 bp, Artificial Sequence
  chemically synthesized
taagatctggtacaatgcaggg

SEQ ID NO: 1410256 - DNA, 22 bp, Artificial Sequence
  chemically synthesized
atcatgggaatccctgcattgt

SEQ ID NO: 1410257 - DNA, 22 bp, Artificial Sequence
  chemically synthesized
ctctaagatctggtacaatgca

SEQ ID NO: 1410258 - DNA, 22 bp, Artificial Sequence
  chemically synthesized
cctctaagatctggtacaatgc

SEQ ID NO: 1410259 - DNA, 22 bp, Artificial Sequence
  chemically synthesized
tcctctaagatctggtacaatg

SEQ ID NO: 1410260 - DNA, 22 bp, Artificial Sequence
  chemically synthesized
ttcctctaagatctggtacaat

SEQ ID NO: 1410261 - DNA, 22 bp, Artificial Sequence
  chemically synthesized
aaagcttttcctctaagatctg

SEQ ID NO: 1410262 - DNA, 22 bp, Artificial Sequence
  chemically synthesized
cattgtaccagatcttagagga

SEQ ID NO: 1410263 - DNA, 22 bp, Artificial Sequence
  chemically synthesized
taccagatcttagaggaaaagc

SEQ ID NO: 1410264 - DNA, 22 bp, Artificial Sequence
  chemically synthesized
agaggaaaagctttcaattttt

SEQ ID NO: 1410265 - DNA, 22 bp, Artificial Sequence
  chemically synthesized
gaggaaaagctttcaatttttt

SEQ ID NO: 1410266 - DNA, 22 bp, Artificial Sequence
  chemically synthesized
taaccaacggggaaaaaattga

SEQ ID NO: 1410267 - DNA, 22 bp, Artificial Sequence
  chemically synthesized
acattgtaaccaacggggaaaa

SEQ ID NO: 1410268 - DNA, 22 bp, Artificial Sequence
  chemically synthesized
tcaattttttccccgttggtta

SEQ ID NO: 1410269 - DNA, 22 bp, Artificial Sequence
  chemically synthesized
caattttttccccgttggttac

SEQ ID NO: 1410270 - DNA, 22 bp, Artificial Sequence
  chemically synthesized
atagctaacattgtaaccaacg

SEQ ID NO: 1410271 - DNA, 22 bp, Artificial Sequence
  chemically synthesized
aattttttccccgttggttaca

SEQ ID NO: 1410272 - DNA, 22 bp, Artificial Sequence
  chemically synthesized
tttccccgttggttacaatgtt

SEQ ID NO: 1410273 - DNA, 22 bp, Artificial Sequence
  chemically synthesized
ttccccgttggttacaatgtta

SEQ ID NO: 1410274 - DNA, 22 bp, Artificial Sequence
  chemically synthesized
tccccgttggttacaatgttag

SEQ ID NO: 1410275 - DNA, 22 bp, Artificial Sequence
  chemically synthesized
ccccgttggttacaatgttagc

SEQ ID NO: 1410276 - DNA, 22 bp, Artificial Sequence
  chemically synthesized
cccgttggttacaatgttagct

SEQ ID NO: 1410277 - DNA, 22 bp, Artificial Sequence
  chemically synthesized
tgaaaaactcatagctaacatt

SEQ ID NO: 1410278 - DNA, 22 bp, Artificial Sequence
  chemically synthesized
atgaaaaactcatagctaacat

SEQ ID NO: 1410279 - DNA, 22 bp, Artificial Sequence
  chemically synthesized
gttacaatgttagctatgagtt

SEQ ID NO: 1410280 - DNA, 22 bp, Artificial Sequence
  chemically synthesized
caatgttagctatgagtttttc

SEQ ID NO: 1410281 - DNA, 22 bp, Artificial Sequence
  chemically synthesized
gctatgagtttttcataaatgg

SEQ ID NO: 1410282 - DNA, 22 bp, Artificial Sequence
  chemically synthesized
tgagtttttcataaatggcctt

SEQ ID NO: 1410283 - DNA, 22 bp, Artificial Sequence
  chemically synthesized
catcaacataataaaggccatt

SEQ ID NO: 1410284 - DNA, 22 bp, Artificial Sequence
  chemically synthesized
gcatcaacataataaaggccat

SEQ ID NO: 1410285 - DNA, 22 bp, Artificial Sequence
  chemically synthesized
ttcataaatggcctttattatg

SEQ ID NO: 1410286 - DNA, 22 bp, Artificial Sequence
  chemically synthesized
tcataaatggcctttattatgt

SEQ ID NO: 1410287 - DNA, 22 bp, Artificial Sequence
  chemically synthesized
cataaatggcctttattatgtt

SEQ ID NO: 1410288 - DNA, 22 bp, Artificial Sequence
  chemically synthesized
ataaatggcctttattatgttg

SEQ ID NO: 1410289 - DNA, 22 bp, Artificial Sequence
  chemically synthesized
tattatgttgatgcaagatcat

SEQ ID NO: 1410290 - DNA, 22 bp, Artificial Sequence
  chemically synthesized
attatgttgatgcaagatcatt

SEQ ID NO: 1410291 - DNA, 22 bp, Artificial Sequence
  chemically synthesized
ttatgttgatgcaagatcattc

SEQ ID NO: 1410292 - DNA, 22 bp, Artificial Sequence
  chemically synthesized
tgttgatgcaagatcattctac

SEQ ID NO: 1410293 - DNA, 22 bp, Artificial Sequence
  chemically synthesized
tcaacaaaataagtgtagaatg

SEQ ID NO: 1410294 - DNA, 22 bp, Artificial Sequence
  chemically synthesized
atgcaagatcattctacactta

SEQ ID NO: 1410295 - DNA, 22 bp, Artificial Sequence
  chemically synthesized
aaaactgtcaacaaaataagtg

SEQ ID NO: 1410296 - DNA, 22 bp, Artificial Sequence
  chemically synthesized
tacacttattttgttgacagtt

SEQ ID NO: 1410297 - DNA, 22 bp, Artificial Sequence
  chemically synthesized
cacttattttgttgacagtttt

SEQ ID NO: 1410298 - DNA, 22 bp, Artificial Sequence
  chemically synthesized
atgggtaaattgaaaactgtca

SEQ ID NO: 1410299 - DNA, 22 bp, Artificial Sequence
  chemically synthesized
attttgttgacagttttcaatt

SEQ ID NO: 1410300 - DNA, 22 bp, Artificial Sequence
  chemically synthesized
ttttgttgacagttttcaattt

SEQ ID NO: 1410301 - DNA, 22 bp, Artificial Sequence
  chemically synthesized
tgttgacagttttcaatttacc

SEQ ID NO: 1410302 - DNA, 22 bp, Artificial Sequence
  chemically synthesized
gttgacagttttcaatttaccc

SEQ ID NO: 1410303 - DNA, 22 bp, Artificial Sequence
  chemically synthesized
ttgacagttttcaatttaccca

SEQ ID NO: 1410304 - DNA, 22 bp, Artificial Sequence
  chemically synthesized
aacatgtattcatgggtaaatt

SEQ ID NO: 1410305 - DNA, 22 bp, Artificial Sequence
  chemically synthesized
acagttttcaatttacccatga

SEQ ID NO: 1410306 - DNA, 22 bp, Artificial Sequence
  chemically synthesized
aaaaagttcaacatgtattcat

SEQ ID NO: 1410307 - DNA, 22 bp, Artificial Sequence
  chemically synthesized
tcaatttacccatgaatacatg

SEQ ID NO: 1410308 - DNA, 22 bp, Artificial Sequence
  chemically synthesized
gaaaaagttcaacatgtattca

SEQ ID NO: 1410309 - DNA, 22 bp, Artificial Sequence
  chemically synthesized
caatttacccatgaatacatgt

SEQ ID NO: 1410310 - DNA, 22 bp, Artificial Sequence
  chemically synthesized
aatttacccatgaatacatgtt

SEQ ID NO: 1410311 - DNA, 22 bp, Artificial Sequence
  chemically synthesized
acccatgaatacatgttgaact

SEQ ID NO: 1410312 - DNA, 22 bp, Artificial Sequence
  chemically synthesized
cccatgaatacatgttgaactt

SEQ ID NO: 1410313 - DNA, 22 bp, Artificial Sequence
  chemically synthesized
atagatgcagaaaaaaccattt

SEQ ID NO: 1410314 - DNA, 22 bp, Artificial Sequence
  chemically synthesized
aatagatgcagaaaaaaccatt

SEQ ID NO: 1410315 - DNA, 22 bp, Artificial Sequence
  chemically synthesized
aactttttcaaatggttttttc

SEQ ID NO: 1410316 - DNA, 22 bp, Artificial Sequence
  chemically synthesized
tttcaaatggttttttctgcat

SEQ ID NO: 1410317 - DNA, 22 bp, Artificial Sequence
  chemically synthesized
ttcaaatggttttttctgcatc

SEQ ID NO: 1410318 - DNA, 22 bp, Artificial Sequence
  chemically synthesized
tcaaatggttttttctgcatct

SEQ ID NO: 1410319 - DNA, 22 bp, Artificial Sequence
  chemically synthesized
caaatggttttttctgcatcta

SEQ ID NO: 1410320 - DNA, 22 bp, Artificial Sequence
  chemically synthesized
aaatggttttttctgcatctat

SEQ ID NO: 1410321 - DNA, 22 bp, Artificial Sequence
  chemically synthesized
tttctgcatctattaagatggt

SEQ ID NO: 1410322 - DNA, 22 bp, Artificial Sequence
  chemically synthesized
ttctgcatctattaagatggtc

SEQ ID NO: 1410323 - DNA, 22 bp, Artificial Sequence
  chemically synthesized
tctgcatctattaagatggtca

SEQ ID NO: 1410324 - DNA, 22 bp, Artificial Sequence
  chemically synthesized
ctgcatctattaagatggtcat

SEQ ID NO: 1410325 - DNA, 22 bp, Artificial Sequence
  chemically synthesized
tgcatctattaagatggtcatg

SEQ ID NO: 1410326 - DNA, 22 bp, Artificial Sequence
  chemically synthesized
catctattaagatggtcatgtg

SEQ ID NO: 1410327 - DNA, 22 bp, Artificial Sequence
  chemically synthesized
ttaagatggtcatgtggttctt

SEQ ID NO: 1410328 - DNA, 22 bp, Artificial Sequence
  chemically synthesized
agatggtcatgtggttcttgtc

SEQ ID NO: 1410329 - DNA, 22 bp, Artificial Sequence
  chemically synthesized
ttgtcttttactccgtttatgt

SEQ ID NO: 1410330 - DNA, 22 bp, Artificial Sequence
  chemically synthesized
gtcttttactccgtttatgtga

SEQ ID NO: 1410331 - DNA, 22 bp, Artificial Sequence
  chemically synthesized
tcttttactccgtttatgtgat

SEQ ID NO: 1410332 - DNA, 22 bp, Artificial Sequence
  chemically synthesized
ttactccgtttatgtgatatat

SEQ ID NO: 1410333 - DNA, 22 bp, Artificial Sequence
  chemically synthesized
tactccgtttatgtgatatatc

SEQ ID NO: 1410334 - DNA, 22 bp, Artificial Sequence
  chemically synthesized
actccgtttatgtgatatatca

SEQ ID NO: 1410335 - DNA, 22 bp, Artificial Sequence
  chemically synthesized
ctccgtttatgtgatatatcac

SEQ ID NO: 1410336 - DNA, 22 bp, Artificial Sequence
  chemically synthesized
cgtttatgtgatatatcacatt

SEQ ID NO: 1410337 - DNA, 22 bp, Artificial Sequence
  chemically synthesized
atgtgatatatcacattgattg

SEQ ID NO: 1410338 - DNA, 22 bp, Artificial Sequence
  chemically synthesized
tgtgatatatcacattgattga

SEQ ID NO: 1410339 - DNA, 22 bp, Artificial Sequence
  chemically synthesized
gtatggcatgcaaatcaatcaa

SEQ ID NO: 1410340 - DNA, 22 bp, Artificial Sequence
  chemically synthesized
attgatttgcatgccataccaa

SEQ ID NO: 1410341 - DNA, 22 bp, Artificial Sequence
  chemically synthesized
caagatgcaaggttggtatggc

SEQ ID NO: 1410342 - DNA, 22 bp, Artificial Sequence
  chemically synthesized
atttgcatgccataccaacctt

SEQ ID NO: 1410343 - DNA, 22 bp, Artificial Sequence
  chemically synthesized
tctccaagatgcaaggttggta

SEQ ID NO: 1410344 - DNA, 22 bp, Artificial Sequence
  chemically synthesized
atctccaagatgcaaggttggt

SEQ ID NO: 1410345 - DNA, 22 bp, Artificial Sequence
  chemically synthesized
gcatgccataccaaccttgcat

SEQ ID NO: 1410346 - DNA, 22 bp, Artificial Sequence
  chemically synthesized
catgccataccaaccttgcatc

SEQ ID NO: 1410347 - DNA, 22 bp, Artificial Sequence
  chemically synthesized
gcatcttggagataaatcccac

SEQ ID NO: 1410348 - DNA, 22 bp, Artificial Sequence
  chemically synthesized
catcttggagataaatcccacc

SEQ ID NO: 1410349 - DNA, 22 bp, Artificial Sequence
  chemically synthesized
tataccatgatcaggtgggatt

SEQ ID NO: 1410350 - DNA, 22 bp, Artificial Sequence
  chemically synthesized
ggagataaatcccacctgatca

SEQ ID NO: 1410351 - DNA, 22 bp, Artificial Sequence
  chemically synthesized
gagataaatcccacctgatcat

SEQ ID NO: 1410352 - DNA, 22 bp, Artificial Sequence
  chemically synthesized
aacagtacatcaaaaggattat

SEQ ID NO: 1410353 - DNA, 22 bp, Artificial Sequence
  chemically synthesized
atcatggtatataatccttttg

SEQ ID NO: 1410354 - DNA, 22 bp, Artificial Sequence
  chemically synthesized
gcaaaacaaattcaacagtaca

SEQ ID NO: 1410355 - DNA, 22 bp, Artificial Sequence
  chemically synthesized
ttgatgtactgttgaatttgtt

SEQ ID NO: 1410356 - DNA, 22 bp, Artificial Sequence
  chemically synthesized
tgatgtactgttgaatttgttt

SEQ ID NO: 1410357 - DNA, 22 bp, Artificial Sequence
  chemically synthesized
gatgtactgttgaatttgtttt

SEQ ID NO: 1410358 - DNA, 22 bp, Artificial Sequence
  chemically synthesized
atgtactgttgaatttgttttg

SEQ ID NO: 1410359 - DNA, 22 bp, Artificial Sequence
  chemically synthesized
aataaaatactagcaaaacaaa

SEQ ID NO: 1410360 - DNA, 22 bp, Artificial Sequence
  chemically synthesized
ttgaatttgttttgctagtatt

SEQ ID NO: 1410361 - DNA, 22 bp, Artificial Sequence
  chemically synthesized
aatttgttttgctagtatttta

SEQ ID NO: 1410362 - DNA, 22 bp, Artificial Sequence
  chemically synthesized
gttttgctagtattttattgag

SEQ ID NO: 1410363 - DNA, 22 bp, Artificial Sequence
  chemically synthesized
ttttgctagtattttattgagg

SEQ ID NO: 1410364 - DNA, 22 bp, Artificial Sequence
  chemically synthesized
tgctagtattttattgaggatt

SEQ ID NO: 1410365 - DNA, 22 bp, Artificial Sequence
  chemically synthesized
gctagtattttattgaggattt

SEQ ID NO: 1410366 - DNA, 22 bp, Artificial Sequence
  chemically synthesized
ctagtattttattgaggatttt

SEQ ID NO: 1410367 - DNA, 22 bp, Artificial Sequence
  chemically synthesized
gtattttattgaggatttttgg

SEQ ID NO: 1410368 - DNA, 22 bp, Artificial Sequence
  chemically synthesized
atgtgtatagatccaaaaatcc

SEQ ID NO: 1410369 - DNA, 22 bp, Artificial Sequence
  chemically synthesized
tgatgtgtatagatccaaaaat

SEQ ID NO: 1410370 - DNA, 22 bp, Artificial Sequence
  chemically synthesized
tattgaggatttttggatctat

SEQ ID NO: 1410371 - DNA, 22 bp, Artificial Sequence
  chemically synthesized
attgaggatttttggatctata

SEQ ID NO: 1410372 - DNA, 22 bp, Artificial Sequence
  chemically synthesized
ttgaggatttttggatctatac

SEQ ID NO: 1410373 - DNA, 22 bp, Artificial Sequence
  chemically synthesized
aggatttttggatctatacaca

SEQ ID NO: 1410374 - DNA, 22 bp, Artificial Sequence
  chemically synthesized
caggagggtaactctgatgtgt

SEQ ID NO: 1410375 - DNA, 22 bp, Artificial Sequence
  chemically synthesized
ttggatctatacacatcagagt

SEQ ID NO: 1410376 - DNA, 22 bp, Artificial Sequence
  chemically synthesized
tggatctatacacatcagagtt

SEQ ID NO: 1410377 - DNA, 22 bp, Artificial Sequence
  chemically synthesized
ggatctatacacatcagagtta

SEQ ID NO: 1410378 - DNA, 22 bp, Artificial Sequence
  chemically synthesized
gatctatacacatcagagttac

SEQ ID NO: 1410379 - DNA, 22 bp, Artificial Sequence
  chemically synthesized
tacacatcagagttaccctcct

SEQ ID NO: 1410380 - DNA, 22 bp, Artificial Sequence
  chemically synthesized
ccctcctgtagtgttcttttat

SEQ ID NO: 1410381 - DNA, 22 bp, Artificial Sequence
  chemically synthesized
ctgtagtgttcttttattgtgg

SEQ ID NO: 1410382 - DNA, 22 bp, Artificial Sequence
  chemically synthesized
tagtgttcttttattgtggtat

SEQ ID NO: 1410383 - DNA, 22 bp, Artificial Sequence
  chemically synthesized
gcaccaaagccaggcaaagata

SEQ ID NO: 1410384 - DNA, 22 bp, Artificial Sequence
  chemically synthesized
ttttattgtggtatctttgcct

SEQ ID NO: 1410385 - DNA, 22 bp, Artificial Sequence
  chemically synthesized
ttattgtggtatctttgcctgg

SEQ ID NO: 1410386 - DNA, 22 bp, Artificial Sequence
  chemically synthesized
tattgtggtatctttgcctggc

SEQ ID NO: 1410387 - DNA, 22 bp, Artificial Sequence
  chemically synthesized
attgtggtatctttgcctggct

SEQ ID NO: 1410388 - DNA, 22 bp, Artificial Sequence
  chemically synthesized
ttgtggtatctttgcctggctt

SEQ ID NO: 1410389 - DNA, 22 bp, Artificial Sequence
  chemically synthesized
tggtatctttgcctggctttgg

SEQ ID NO: 1410390 - DNA, 22 bp, Artificial Sequence
  chemically synthesized
tgcctggctttggtgccagtgt

SEQ ID NO: 1410391 - DNA, 22 bp, Artificial Sequence
  chemically synthesized
gcctggctttggtgccagtgtg

SEQ ID NO: 1410392 - DNA, 22 bp, Artificial Sequence
  chemically synthesized
tgaagccagaatcacactggca

SEQ ID NO: 1410393 - DNA, 22 bp, Artificial Sequence
  chemically synthesized
cctggctttggtgccagtgtga

SEQ ID NO: 1410394 - DNA, 22 bp, Artificial Sequence
  chemically synthesized
atgaagccagaatcacactggc

SEQ ID NO: 1410395 - DNA, 22 bp, Artificial Sequence
  chemically synthesized
tatgaagccagaatcacactgg

SEQ ID NO: 1410396 - DNA, 22 bp, Artificial Sequence
  chemically synthesized
gctttggtgccagtgtgattct

SEQ ID NO: 1410397 - DNA, 22 bp, Artificial Sequence
  chemically synthesized
tggtgccagtgtgattctggct

SEQ ID NO: 1410398 - DNA, 22 bp, Artificial Sequence
  chemically synthesized
ggtgccagtgtgattctggctt

SEQ ID NO: 1410399 - DNA, 22 bp, Artificial Sequence
  chemically synthesized
gtgccagtgtgattctggcttc

SEQ ID NO: 1410400 - DNA, 24 bp, Artificial Sequence
  chemically synthesized
agtctgagtaggagctaaaatatt

SEQ ID NO: 1410401 - DNA, 24 bp, Artificial Sequence
  chemically synthesized
cttgatccatatgcttttacctgc

SEQ ID NO: 1410402 - DNA, 24 bp, Artificial Sequence
  chemically synthesized
atatttgttcttacaggcaacaat

SEQ ID NO: 1410403 - DNA, 23 bp, Artificial Sequence
  chemically synthesized
tgcaaaaacccaaaatattttag

SEQ ID NO: 1410404 - DNA, 23 bp, Artificial Sequence
  chemically synthesized
gcaaaaacccaaaatattttagc

SEQ ID NO: 1410405 - DNA, 23 bp, Artificial Sequence
  chemically synthesized
caaaaacccaaaatattttagct

SEQ ID NO: 1410406 - DNA, 23 bp, Artificial Sequence
  chemically synthesized
ccgctgcccaatgccatcctgga

SEQ ID NO: 1410407 - DNA, 23 bp, Artificial Sequence
  chemically synthesized
tgttttgcctttttggtatctta

SEQ ID NO: 1410408 - DNA, 23 bp, Artificial Sequence
  chemically synthesized
gttttgcctttttggtatcttac

SEQ ID NO: 1410409 - DNA, 23 bp, Artificial Sequence
  chemically synthesized
ttttgcctttttggtatcttaca

SEQ ID NO: 1410410 - DNA, 23 bp, Artificial Sequence
  chemically synthesized
gcctttttggtatcttacaggaa

SEQ ID NO: 1410411 - DNA, 23 bp, Artificial Sequence
  chemically synthesized
cctttttggtatcttacaggaac

SEQ ID NO: 1410412 - DNA, 23 bp, Artificial Sequence
  chemically synthesized
tggtatcttacaggaactccagg

SEQ ID NO: 1410413 - DNA, 23 bp, Artificial Sequence
  chemically synthesized
tttttccttttattctagttgaa

SEQ ID NO: 1410414 - DNA, 23 bp, Artificial Sequence
  chemically synthesized
tccttttattctagttgaaagaa

SEQ ID NO: 1410415 - DNA, 23 bp, Artificial Sequence
  chemically synthesized
ccttttattctagttgaaagaat

SEQ ID NO: 1410416 - DNA, 23 bp, Artificial Sequence
  chemically synthesized
tcaacagatctgtcaaatcgcct

SEQ ID NO: 1410417 - DNA, 23 bp, Artificial Sequence
  chemically synthesized
tcttgatccatatgcttttacct

SEQ ID NO: 1410418 - DNA, 23 bp, Artificial Sequence
  chemically synthesized
cttgatccatatgcttttacctg

SEQ ID NO: 1410419 - DNA, 23 bp, Artificial Sequence
  chemically synthesized
ttgatccatatgcttttacctgc

SEQ ID NO: 1410420 - DNA, 23 bp, Artificial Sequence
  chemically synthesized
gttcttctagcctggagaaagaa

SEQ ID NO: 1410421 - DNA, 23 bp, Artificial Sequence
  chemically synthesized
ttcttctagcctggagaaagaag

SEQ ID NO: 1410422 - DNA, 23 bp, Artificial Sequence
  chemically synthesized
attcttctttctccaggctagaa

SEQ ID NO: 1410423 - DNA, 23 bp, Artificial Sequence
  chemically synthesized
ttcttctttctccaggctagaag

SEQ ID NO: 1410424 - DNA, 23 bp, Artificial Sequence
  chemically synthesized
ttgtagactatcttttatattct

SEQ ID NO: 1410425 - DNA, 23 bp, Artificial Sequence
  chemically synthesized
tactgttttaaaatttttatatt

SEQ ID NO: 1410426 - DNA, 23 bp, Artificial Sequence
  chemically synthesized
actgttttaaaatttttatatta

SEQ ID NO: 1410427 - DNA, 23 bp, Artificial Sequence
  chemically synthesized
ctgttttaaaatttttatattac

SEQ ID NO: 1410428 - DNA, 23 bp, Artificial Sequence
  chemically synthesized
aaaatttttatattacagaatat

SEQ ID NO: 1410429 - DNA, 23 bp, Artificial Sequence
  chemically synthesized
aaatttttatattacagaatata

SEQ ID NO: 1410430 - DNA, 19 bp, Artificial Sequence
  chemically synthesized
cctactcagactgttactc

SEQ ID NO: 1410431 - DNA, 19 bp, Artificial Sequence
  chemically synthesized
actctggtgacacaacctg

SEQ ID NO: 1410432 - DNA, 19 bp, Artificial Sequence
  chemically synthesized
acacaacctgtggttacta

SEQ ID NO: 1410433 - DNA, 19 bp, Artificial Sequence
  chemically synthesized
atgttggaggtacctgctc

SEQ ID NO: 1410434 - DNA, 19 bp, Artificial Sequence
  chemically synthesized
tgctctggcagatttcaac

SEQ ID NO: 1410435 - DNA, 19 bp, Artificial Sequence
  chemically synthesized
gctctggcagatttcaacc

SEQ ID NO: 1410436 - DNA, 19 bp, Artificial Sequence
  chemically synthesized
ggcagatttcaaccgggct

SEQ ID NO: 1410437 - DNA, 19 bp, Artificial Sequence
  chemically synthesized
ttggacagaacttaccgac

SEQ ID NO: 1410438 - DNA, 19 bp, Artificial Sequence
  chemically synthesized
catctcgttgatatcctca

SEQ ID NO: 1410439 - DNA, 19 bp, Artificial Sequence
  chemically synthesized
ggtaagttctgtccaagcc

SEQ ID NO: 1410440 - DNA, 19 bp, Artificial Sequence
  chemically synthesized
ggttgaaatctgccagagc

SEQ ID NO: 1410441 - DNA, 19 bp, Artificial Sequence
  chemically synthesized
gcaggtacctccaacatca

SEQ ID NO: 1410442 - DNA, 19 bp, Artificial Sequence
  chemically synthesized
ggcatttctagtttggaga

SEQ ID NO: 1410443 - DNA, 19 bp, Artificial Sequence
  chemically synthesized
cagtttccttagtaaccac

SEQ ID NO: 1410444 - DNA, 19 bp, Artificial Sequence
  chemically synthesized
ccagagtaacagtctgagt

SEQ ID NO: 1410445 - DNA, 19 bp, Artificial Sequence
  chemically synthesized
ggtatcttacaggaactcc

SEQ ID NO: 1410446 - DNA, 19 bp, Artificial Sequence
  chemically synthesized
tcttacaggaactccagga

SEQ ID NO: 1410447 - DNA, 19 bp, Artificial Sequence
  chemically synthesized
aggaactccaggatggcat

SEQ ID NO: 1410448 - DNA, 19 bp, Artificial Sequence
  chemically synthesized
ggaactccaggatggcatt

SEQ ID NO: 1410449 - DNA, 19 bp, Artificial Sequence
  chemically synthesized
ccaggatggcattgggcag

SEQ ID NO: 1410450 - DNA, 19 bp, Artificial Sequence
  chemically synthesized
tcagaacattgaatgcaac

SEQ ID NO: 1410451 - DNA, 19 bp, Artificial Sequence
  chemically synthesized
agaacattgaatgcaactg

SEQ ID NO: 1410452 - DNA, 19 bp, Artificial Sequence
  chemically synthesized
acagatgccagtattctac

SEQ ID NO: 1410453 - DNA, 19 bp, Artificial Sequence
  chemically synthesized
attgggaagcctgaatctg

SEQ ID NO: 1410454 - DNA, 19 bp, Artificial Sequence
  chemically synthesized
gggaagcctgaatctgcgg

SEQ ID NO: 1410455 - DNA, 19 bp, Artificial Sequence
  chemically synthesized
agcctgaatctgcggtggc

SEQ ID NO: 1410456 - DNA, 19 bp, Artificial Sequence
  chemically synthesized
ctcctgccaccgcagattc

SEQ ID NO: 1410457 - DNA, 19 bp, Artificial Sequence
  chemically synthesized
ccgctgcccaatgccatcc

SEQ ID NO: 1410458 - DNA, 19 bp, Artificial Sequence
  chemically synthesized
acaagaacaccttcagaac

SEQ ID NO: 1410459 - DNA, 19 bp, Artificial Sequence
  chemically synthesized
agaacaccttcagaaccgg

SEQ ID NO: 1410460 - DNA, 19 bp, Artificial Sequence
  chemically synthesized
gttaaaggattcaacacaa

SEQ ID NO: 1410461 - DNA, 19 bp, Artificial Sequence
  chemically synthesized
acacaatggctggaagcta

SEQ ID NO: 1410462 - DNA, 19 bp, Artificial Sequence
  chemically synthesized
gctgagcaggtcttaggac

SEQ ID NO: 1410463 - DNA, 19 bp, Artificial Sequence
  chemically synthesized
cagagccaagcttgagtca

SEQ ID NO: 1410464 - DNA, 19 bp, Artificial Sequence
  chemically sythesized
gccaagcttgagtcatgga

SEQ ID NO: 1410465 - DNA, 19 bp, Artificial Sequence
  chemically synthesized
acaagaacaccttcagaac

SEQ ID NO: 1410466 - DNA, 19 bp, Artificial Sequence
  chemically synthesized
agaacaccttcagaaccgg

SEQ ID NO: 1410467 - DNA, 19 bp, Artificial Sequence
  chemically synthesized
gttaaaggattcaacacaa

SEQ ID NO: 1410468 - DNA, 19 bp, Artificial Sequence
  chemically synthesized
acacaatggctggaagcta

SEQ ID NO: 1410469 - DNA, 19 bp, Artificial Sequence
  chemically synthesized
aagaagctgagcaggtctt

SEQ ID NO: 1410470 - DNA, 19 bp, Artificial Sequence
  chemically synthesized
gctgagcaggtcttaggac

SEQ ID NO: 1410471 - DNA, 19 bp, Artificial Sequence
  chemically synthesized
cagagccaagcttgagtca

SEQ ID NO: 1410472 - DNA, 19 bp, Artificial Sequence
  chemically synthesized
gccaagcttgagtcatgga

SEQ ID NO: 1410473 - DNA, 23 bp, Artificial Sequence
  chemically synthesized
  misc_feature (1)..(21): n is a, c, g, or t
nnnnnnnnnnnnnnnnnnnnnrg

SEQ ID NO: 1410474 - protein, 9 aa, Artificial Sequence
  chemically synthesized
LAGLIDADG

SEQ ID NO: 1410475 - DNA, 20 bp, Artificial Sequence
  chemically synthesized
ggggctccaccctcacgagt
